(12) United States Patent
Hsieh et al.

(10) Patent No.: US 8,835,610 B2
(45) Date of Patent: Sep. 16, 2014

(54) IL-17 BINDING PROTEINS

(75) Inventors: Chung-Ming Hsieh, Newton, MA (US); Margaret Hugunin, No. Grafton, MA (US); Yuliya Kutskova, Northborough, MA (US); John E. Memmott, Framingham, MA (US); Jennifer M. Perez, Worcester, MA (US); Suju Zhong, Shrewsbury, MA (US); Edit Tarcsa, Westborough, MA (US); Anca Clabbers, Rutland, MA (US)

(73) Assignee: Abbvie Inc., North Chicago, IL (US)

( * ) Notice: Subject to any disclaimer, the term of this patent is extended or adjusted under 35 U.S.C. 154(b) by 696 days.

(21) Appl. No.: 12/718,841

(22) Filed: Mar. 5, 2010

(65) Prior Publication Data
US 2010/0266531 A1 Oct. 21, 2010

Related U.S. Application Data

(60) Provisional application No. 61/209,272, filed on Mar. 5, 2009.

(51) Int. Cl.
*A61K 39/395* (2006.01)
*C07K 16/24* (2006.01)

(52) U.S. Cl.
USPC .................................................. 530/388.23

(58) Field of Classification Search
None
See application file for complete search history.

(56) References Cited

U.S. PATENT DOCUMENTS

| | | |
|---|---|---|
| 4,526,938 A | 7/1985 | Churchill et al. |
| 4,554,101 A | 11/1985 | Hopp |
| 4,753,894 A | 6/1988 | Frankel et al. |
| 4,816,397 A | 3/1989 | Boss et al. |
| 4,816,567 A | 3/1989 | Cabilly et al. |
| 4,880,078 A | 11/1989 | Inoue et al. |
| 4,943,533 A | 7/1990 | Mendelsohn et al. |
| 4,946,778 A | 8/1990 | Ladner et al. |
| 4,980,286 A | 12/1990 | Morgan et al. |
| 5,006,309 A | 4/1991 | Khalil et al. |
| 5,063,081 A | 11/1991 | Cozzette et al. |
| 5,089,424 A | 2/1992 | Khalil et al. |
| 5,128,326 A | 7/1992 | Balazs et al. |
| 5,135,875 A | 8/1992 | Meucci et al. |
| 5,223,409 A | 6/1993 | Ladner et al. |
| 5,225,539 A | 7/1993 | Winter |
| 5,241,070 A | 8/1993 | Law et al. |
| 5,242,828 A | 9/1993 | Bergström et al. |
| 5,258,498 A | 11/1993 | Huston et al. |
| 5,290,540 A | 3/1994 | Prince et al. |
| 5,294,404 A | 3/1994 | Grandone et al. |
| 5,352,803 A | 10/1994 | Mattingly |
| 5,359,093 A | 10/1994 | Adamczyk et al. |
| 5,403,484 A | 4/1995 | Ladner et al. |
| 5,427,908 A | 6/1995 | Dower et al. |
| 5,468,646 A | 11/1995 | Mattingly et al. |
| 5,496,925 A | 3/1996 | Mattingly |
| 5,500,362 A | 3/1996 | Robinson et al. |
| 5,516,637 A | 5/1996 | Huang et al. |
| 5,530,101 A | 6/1996 | Queen et al. |
| 5,543,524 A | 8/1996 | Mattingly et al. |
| 5,558,864 A | 9/1996 | Bendig et al. |
| 5,565,332 A | 10/1996 | Hoogenboom et al. |
| 5,565,352 A | 10/1996 | Hochstrasser et al. |
| 5,571,698 A | 11/1996 | Ladner et al. |
| 5,573,904 A | 11/1996 | Mattingly |
| 5,580,717 A | 12/1996 | Dower et al. |
| 5,585,089 A | 12/1996 | Queen et al. |
| 5,593,896 A | 1/1997 | Adamczyk et al. |
| 5,624,821 A | 4/1997 | Winter et al. |
| 5,627,052 A | 5/1997 | Schrader |
| 5,641,870 A | 6/1997 | Rinderknecht et al. |
| 5,648,260 A | 7/1997 | Winter et al. |
| 5,658,727 A | 8/1997 | Barbas et al. |
| 5,677,171 A | 10/1997 | Hudziak et al. |
| 5,679,377 A | 10/1997 | Bernstein et al. |
| 5,693,762 A | 12/1997 | Queen et al. |
| 5,698,426 A | 12/1997 | Huse et al. |
| 5,714,350 A | 2/1998 | Co et al. |
| 5,714,352 A | 2/1998 | Jakobovits et al. |
| 5,723,323 A | 3/1998 | Kauffman et al. |
| 5,733,743 A | 3/1998 | Johnson et al. |
| 5,736,137 A | 4/1998 | Anderson et al. |
| 5,750,753 A | 5/1998 | Kimae et al. |
| 5,763,192 A | 6/1998 | Kauffman et al. |
| 5,766,886 A | 6/1998 | Studnicka et al. |
| 5,780,225 A | 7/1998 | Wigler et al. |

(Continued)

FOREIGN PATENT DOCUMENTS

| | | |
|---|---|---|
| EP | 0 471 293 A2 | 2/1992 |
| EP | 0 592 106 A1 | 4/1994 |

(Continued)

OTHER PUBLICATIONS

Goldsby, Immunology, 5th edition, 2003, pp. 82-84.*
Huston et al. (Proc. Natl. Acad. Sci., 85(16):5879-5883, 1988).*
Bird et. al (Science, 242:243-246, 1988).*
Ward et al. (Nature, 341:544-546, 1989).*
van den Beuken et al. (J. Mol. Biol., 310(3):591-601).*
Rudikoff, et al. (Proc. Natl. Acad. Sci. USA, 79(6):1979-1983, 1982).*
McCarthy and Hill (J. Immunol. Methods, 251(1-2):137-149, 2001).*
Chayen (Curr Opin Struct Biol, 14(5):577-583, 2004).*
Voet et al. (Biochemistry, John Wiley & sons, Inc., p. 1100 only, 1990).*
Baslund, Bo et al., "Targeting interleukin-15 in patients with rheumatoid arthritis," Arthr. & Rheum., 52(9): 2686-2692 (2005).
Bruncko et al., "Studies leading to potent, dual inhibitors of Bcl-2 and Bcl-xL," J. Med. Chem., 50(4): 641-662 (2007).
Carroll et al., "The selection of high-producing cell lines using flow cytometry and cell sorting," Expert Opin. Biol. Ther., 4: 1821-1829 (2004).

(Continued)

*Primary Examiner* — Misook Yu
*Assistant Examiner* — Nelson B Moseley, II
(74) *Attorney, Agent, or Firm* — Lathrop & Gage LLP; James H. Velema, Esq.; Diana M. Steel

(57) ABSTRACT

Proteins that bind IL-17 and/or IL-17F are described along with their use in compositions and methods for treating, preventing, and diagnosing IL-17 related diseases and for detecting IL-17 in cells, tissues, samples, and compositions.

64 Claims, No Drawings

(56) References Cited

U.S. PATENT DOCUMENTS

| | | |
|---|---|---|
| 5,783,699 A | 7/1998 | Mattingly et al. |
| 5,789,554 A | 8/1998 | Leung et al. |
| 5,807,715 A | 9/1998 | Morrison et al. |
| 5,814,476 A | 9/1998 | Kauffman et al. |
| 5,817,483 A | 10/1998 | Kauffman et al. |
| 5,821,047 A | 10/1998 | Garrard et al. |
| 5,824,514 A | 10/1998 | Kauffman et al. |
| 5,855,913 A | 1/1999 | Hanes et al. |
| 5,874,064 A | 2/1999 | Edwards et al. |
| 5,891,996 A | 4/1999 | Mateo de Acosta del Rio et al. |
| 5,912,015 A | 6/1999 | Bernstein et al. |
| 5,916,597 A | 6/1999 | Lee et al. |
| 5,916,771 A | 6/1999 | Hori et al. |
| 5,934,272 A | 8/1999 | Lloyd et al. |
| 5,939,598 A | 8/1999 | Kucherlapati et al. |
| 5,969,108 A | 10/1999 | McCafferty et al. |
| 5,976,862 A | 11/1999 | Kauffman et al. |
| 5,985,309 A | 11/1999 | Edwards et al. |
| 5,985,320 A | 11/1999 | Edwards et al. |
| 5,985,615 A | 11/1999 | Jakobovits et al. |
| 5,989,463 A | 11/1999 | Tracy et al. |
| 5,998,209 A | 12/1999 | Jakobovits et al. |
| 6,019,968 A | 2/2000 | Platz et al. |
| 6,066,719 A | 5/2000 | Zapata |
| 6,075,181 A | 6/2000 | Kucherlapati et al. |
| 6,091,001 A | 7/2000 | Jakobovits et al. |
| 6,114,598 A | 9/2000 | Kucherlapati et al. |
| 6,130,364 A | 10/2000 | Jakobovits et al. |
| 6,180,370 B1 | 1/2001 | Queen et al. |
| 6,204,023 B1 | 3/2001 | Robinson et al. |
| 6,214,984 B1 | 4/2001 | Zapata |
| 6,225,047 B1 | 5/2001 | Hutchens et al. |
| 6,235,883 B1 | 5/2001 | Jakobovits et al. |
| 6,258,562 B1 | 7/2001 | Salfeld et al. |
| 6,329,209 B1 | 12/2001 | Wagner et al. |
| 6,350,861 B1 | 2/2002 | Co et al. |
| 6,506,883 B2 | 1/2003 | Meteo de Acosta del Rio et al. |
| 6,660,843 B1 | 12/2003 | Feige et al. |
| 6,699,658 B1 | 3/2004 | Wittrup et al. |
| 6,914,128 B1 | 7/2005 | Salfeld et al. |
| 7,247,301 B2 | 7/2007 | van de Winkel et al. |
| 7,262,028 B2 | 8/2007 | Van Berkel et al. |
| 7,612,181 B2 | 11/2009 | Wu et al. |
| 7,838,638 B2 | 11/2010 | Allan et al. |
| 2002/0137134 A1 | 9/2002 | Gerngross |
| 2003/0091561 A1 | 5/2003 | van de Winkel et al. |
| 2003/0170881 A1 | 9/2003 | Davis et al. |
| 2003/0186374 A1 | 10/2003 | Hufton et al. |
| 2004/0018577 A1 | 1/2004 | Emerson Campbell et al. |
| 2004/0018590 A1 | 1/2004 | Gerngross |
| 2005/0042664 A1 | 2/2005 | Wu et al. |
| 2005/0054078 A1 | 3/2005 | Miller et al. |
| 2005/0147610 A1 | 7/2005 | Ghayur et al. |
| 2006/0018909 A1* | 1/2006 | Oliner et al. ............... 424/155.1 |
| 2006/0104968 A1 | 5/2006 | Bookbinder et al. |
| 2006/0160164 A1 | 7/2006 | Miller et al. |
| 2007/0003567 A1 | 1/2007 | Paterson et al. |
| 2007/0071675 A1 | 3/2007 | Wu et al. |
| 2007/0160576 A1 | 7/2007 | Arnott et al. |
| 2007/0196371 A1 | 8/2007 | Kuestner et al. |
| 2008/0020401 A1 | 1/2008 | Grenier et al. |
| 2008/0219971 A1 | 9/2008 | Smith et al. |
| 2008/0248493 A1 | 10/2008 | Mattingly et al. |
| 2008/0269467 A1 | 10/2008 | Allan et al. |
| 2010/0099103 A1 | 4/2010 | Hsieh et al. |
| 2010/0167301 A1 | 7/2010 | Collier et al. |
| 2012/0034160 A1 | 2/2012 | Ghayur et al. |

FOREIGN PATENT DOCUMENTS

| | | |
|---|---|---|
| EP | 0 239 400 B1 | 8/1994 |
| EP | 1 176 195 A1 | 1/2002 |
| EP | 0 592 106 B1 | 11/2004 |
| EP | 0 519 596 B1 | 2/2005 |
| EP | 1 444 268 A2 | 5/2009 |
| WO | WO 90/02809 | 3/1990 |
| WO | WO 90/05144 A1 | 5/1990 |
| WO | WO 90/14424 | 11/1990 |
| WO | WO 90/14430 | 11/1990 |
| WO | WO 90/14443 | 11/1990 |
| WO | WO 91/05548 | 5/1991 |
| WO | WO 91/09967 | 7/1991 |
| WO | WO 91/10737 | 7/1991 |
| WO | WO 91/10741 | 7/1991 |
| WO | WO 91/17271 | 11/1991 |
| WO | WO 92/01047 | 1/1992 |
| WO | WO 92/02551 | 2/1992 |
| WO | WO 92/03461 | 3/1992 |
| WO | WO 92/09690 | 6/1992 |
| WO | WO 92/11272 | 7/1992 |
| WO | WO 92/15679 | 9/1992 |
| WO | WO 92/18619 | 10/1992 |
| WO | WO 92/19244 | 11/1992 |
| WO | WO 92/20791 | 11/1992 |
| WO | WO 92/22324 | 12/1992 |
| WO | WO 93/01288 | 1/1993 |
| WO | WO 93/06213 A1 | 4/1993 |
| WO | WO 93/11236 | 6/1993 |
| WO | WO 94/02602 | 2/1994 |
| WO | WO 94/18219 | 8/1994 |
| WO | WO 95/15982 | 6/1995 |
| WO | WO 95/20045 | 7/1995 |
| WO | WO 95/20401 | 8/1995 |
| WO | WO 96/20698 | 7/1996 |
| WO | WO 96/33735 | 10/1996 |
| WO | WO 96/34096 | 10/1996 |
| WO | WO 96/40210 | 12/1996 |
| WO | WO 97/20032 | 6/1997 |
| WO | WO 97/29131 | 8/1997 |
| WO | WO 97/32572 | 9/1997 |
| WO | WO 97/44013 | 11/1997 |
| WO | WO 98/16654 | 4/1998 |
| WO | WO 98/24893 | 6/1998 |
| WO | WO 98/31346 | 7/1998 |
| WO | WO 98/31700 | 7/1998 |
| WO | WO 98/50433 | 11/1998 |
| WO | WO 99/06834 | 2/1999 |
| WO | WO 99/15154 | 4/1999 |
| WO | WO 99/20253 | 4/1999 |
| WO | WO 99/25044 | 5/1999 |
| WO | WO 99/45031 | 9/1999 |
| WO | WO 99/51773 | 10/1999 |
| WO | WO 99/53049 | 10/1999 |
| WO | WO 99/54342 | 10/1999 |
| WO | WO 99/66903 | 12/1999 |
| WO | WO 00/09560 | 2/2000 |
| WO | WO 00/34337 | 6/2000 |
| WO | WO 00/37504 | 6/2000 |
| WO | WO 00/47625 A2 | 8/2000 |
| WO | WO 00/56772 | 9/2000 |
| WO | WO 00/56934 | 9/2000 |
| WO | WO 01/62931 | 8/2001 |
| WO | WO 01/77342 | 10/2001 |
| WO | WO 01/83525 | 11/2001 |
| WO | WO 01/88138 | 11/2001 |
| WO | WO 02/02773 | 1/2002 |
| WO | WO 02/072636 | 9/2002 |
| WO | WO 03/016466 | 2/2003 |
| WO | WO 03/035835 | 5/2003 |
| WO | WO 03/039486 | 5/2003 |
| WO | WO 03/042231 A2 | 5/2003 |
| WO | WO 03/043321 | 5/2003 |
| WO | WO 2004/078140 | 9/2004 |
| WO | WO 2004/110369 A2 | 12/2004 |
| WO | WO 2006/054059 A1 | 5/2006 |
| WO | WO 2007/005608 A2 | 1/2007 |
| WO | WO 2007/024715 A2 | 3/2007 |
| WO | WO 2007/070750 A1 | 6/2007 |
| WO | WO 2007/080174 A2 | 7/2007 |
| WO | WO 2007/117749 A2 | 10/2007 |
| WO | WO 2007/124299 | 11/2007 |
| WO | WO 2007/149032 A1 | 12/2007 |
| WO | WO 2008/001063 A1 | 1/2008 |

(56) References Cited

FOREIGN PATENT DOCUMENTS

| WO | WO 2008/021156 A2 | 2/2008 |
|----|-------------------|--------|
| WO | WO 2008/047134 A2 | 4/2008 |
| WO | WO 2008/082984    | 7/2008 |
| WO | WO 2010/078443 A1 | 7/2010 |

OTHER PUBLICATIONS

Choi et al., "Recombinant chimeric OKT3 scFv IgM antibodies mediate immune suppression while reducing T cell activation in vitro," Eur. J. Immunol., 31(1): 94-106 (2001).

Cox et al., "Measurement of cytokine release at the single cell level using the ELISPOT assay," Methods, 38(4): 274-282 (2006).

Dall'Acqua et al., "Properties of human IgG1s engineered for enhanced binding to the neonatal Fc receptor (FcRn)," J. Biol. Chem., 281: 23514-23524 (2006).

Dall'Acqua et al., "Increasing the affinity of a human IgG1 for the neonatal Fc receptor: biological consequences," J Immunol., 169(9): 5171-5180 (2002).

DeLuca et al., "Marine and botanical lipids as immunomodulatory and therapeutic agents in the treatment of rheumatoid arthritis," Rheum. Dis. Clin. North Am., 21: 759-777 (1995).

Desmet et al., "Anchor profiles of HLA-specific peptides: analysis by a novel affinity scoring method and experimental validation" Proteins, vol. 58, p. 53-69 (2005).

Ghetie et al., "Increasing the serum persistence of an IgG fragment by random mutagenesis," Nature Biotechnol., 15 (7): 637-640 (1997).

Giegé et al., Chapter 1, In Crystallization of Nucleic Acids and Proteins, a Practical Approach, 2nd ed., (Ducruix and Giegé, eds.) (Oxford University Press, New York, 1999) pp. 1-16.

Goodson, J. M., Chapter 6, In Medical Applications of Controlled Release, vol. II, Applications and Evaluation, (Langer and Wise, eds.) (CRC Press, Inc., Boca Raton, 1984), pp. 115-138.

Hammerling et al., eds., "Monoclonal Antibodies and T-Cell Hybridomas," In Research Monographs in Immunology, vol. 3 (J.L. Turk, General Editor) (Elsevier, New York, 1981), pp. 563-587.

Hinton et al., "Engineered human IgG antibodies with longer serum half-lives in primates," J. Biol. Chem., 279(8): 6213-6216 (2004).

Jiang et al., "Regulation of recombinant monoclonal antibody production in Chinese hamster ovary cells: a comparative study of gene copy number, mRNA level, and protein expression," Biotechnol. Prog., 22(1): 313-318 (2006).

Jones, A.G., Dept. Chem. Biochem. Eng., Univ. Coll. London, "Particle formation and separation in suspension crystallization processes," Chapter 4, In Processing of Solid-Liquid Suspensions, (Shamlou, ed.) (Butterworth-Heinemann, Oxford, UK, 1993) pp. 93-117.

Jones, A.J.S., "Analytical methods for the assessment of protein formulations and delivery systems," Chapter 2, In Formulation and Delivery of Proteins and Peptides, 1st ed., (Cleland and Langer, eds.) (American Chemical Society, Washington, DC, 1994) pp. 22-45.

Jones, R., "Rovelizumab—ICOS Corp," IDrugs, 3(4): 442-446 (2000).

Kanda et al., "Establishment of a GDP-mannose 4,6-dehydratase (GMD) knockout host cell line: a new strategy for generating completely non-fucosylated recombinant therapeutics," J. Biotechnol., 130(3): 300-310 (2007).

Kashmiri et al, "SDR grafting—a new approach to antibody humanization," Methods, 36(1): 25-34 (2005).

Kipriyanov et al., "Generation of recombinant antibodies," Mol. Biotechnol., 12: 173-201 (1999).

Köhler and Milstein, "Continuous cultures of fused cells secreting antibody of predefined specificity," Nature, 256: 495-497 (1975).

Legros et al., "Characterization of an anti-*Borrelia burgdorferi* OspA conformational epitope by limited proteolysis of monoclnla antibody-bound antigen and mass spectrometric peptide mapping," Protein Science, 9: 1002-1010 (2000).

Lund et al., "Human Fc gamma RI and Fc gamma RII interact with distinct but overlapping sites on human IgG," J. Immunol., 147: 2657 (1991).

Madhusudan et al., "A phase II study of etanercept (Enbrel), a tumor necrosis factor alpha inhibitor in patients with metastatic breast cancer," Clin. Cancer Res., 10(19): 6528-6534 (2004).

Marquina et al., "Inhibition of B cell death causes the development of an IgA nephropathy in (New Zealand White x C57BL/6)F1-bc1-2 transgenic mice," J. Immunol., 172(11): 7177-7185 (2004).

Morrison and Schlom, "Recombinant Chimeric Monoclonal Antibodies," Chapter 1, In Important Advances in Oncology 1990 (J.B. Lippincott Company, Philadelphia, 1990), pp. 3-18.

Nishimoto et al., "Treatment of rheumatoid arthritis with humanized anti-interleukin-6 receptor antibody," Arthritis Rheum., 50(6): 1761-1769 (2004).

O'Connor et al., "Requirement of multiple phage displayed peptide libraries for optimal mapping of a conformational antibody epitope on CCR5," J. Immunolog. Meth., 299: 21-35 (2005).

Pearlman et al., "Analysis of protein drugs," Chapter 6, In Peptide and Protein Drug Delivery, 1st ed., [In Advances in Parenteral Sciences, vol. 4] (Lee, ed.) (Marcel Dekker, Inc., New York, 1991) pp. 247-301.

Petkova et al., "Enhanced half-life of genetically engineered human IgG1 antibodies in a humanized FcRn mouse model: potential application in humorally mediated autoimmune disease," International Immunol., 18: 1759-1769 (2006).

Presta, L.G., "Engineering of therapeutic antibodies to minimize immunogenicity and optimize function," Adv. Drug. Del. Rev., 58: 640-656 (2006).

Robinson, C., "Gene therapy—proceeding from laboratory to clinic," Trends Biotechnol., 11(5): 155 (1993).

Roguska et al., "A comparison of two murine monoclonal antibodies humanized by CDR-grafting and variable domain resurfacing," Protein Engineering, 9(10): 895-904 (1996).

Satoh et al., "Non-fucosylated therapeutic antibodies as next-generation therapeutic antibodies," Expert Opin. Biol. Ther., 6(11): 1161-1173 (2006).

Stickler et al., "CD4+ T-cell epitope determination using unexposed human donor peripheral blood mononuclear cells," J. Immunotherapy, 23: 654-660 (2000).

Vaccaro et al., "Divergent activities of an engineered antibody in murine and human systems have implications for therapeutic antibodies," Proceed. Natl. Acad. Sci. USA, 103: 18709-18714 (2006).

Wing et al., "Ex-vivo whole blood cultures for predicting cytokine-release syndrome: dependence on target antigen and antibody isotype," Therapeutic Immunol., 2(4): 183-190 (1995).

Wu, Chengbin, et al., "IL-18 receptor {beta}-induced changes in the presentation of IL-18 binding sites affect ligand binding and signal transduction," J. Immunol., 170: 5571-5577 (2003).

Wurm, F.M., "Production of recombinant protein therapeutics in cultivated mammalian cells," Nature Biotechnol., 22 (11): 1393-1398 (2004).

Zola et al., "CD molecules 2005: human cell differentiation molecules," Blood, 106: 3123-3126 (2005).

Baumgartner et al., "Double blind, placebo controlled trial of tumor necrosis factor receptor fusion protein (TNFR: Fc) in active rheumatoid arthritis," J. Invest. Med., vol. 44, No. 3, 235A (Saturday Morning Concurrent Sessions) (Mar. 1996).

Bessis et al., "Use of hollow fibers filled with cells engineered to secrete IL 4 or IL 13 for treatment of experimental arthritis," (Abstract No. 1681), Arthritis Rheum., vol. 39, No. 9 (supplement), S308 (1996).

Chikanza et al., "Treatment of patients with rheumatoid arthritis with RP73401 phosphodiesterase Type IV inhibitor," (Abstract No. 1527), Arthritis Rheum., vol. 39, No. 9 (supplement), S282 (1996).

Enrich et al., "Demonstration of selective COX 2 inhibition by MK 966 in humans," (Abstract No. 328), Arthritis Rheum., vol. 39, No. 9 (supplement), S81 (1996).

Enrich et al., "Efficacy of MK-966, a highly selective inhibitor of COX 2, in the treatment of postoperative dental pain," (Abstract No. 329), Arthritis Rheum., vol. 39, No. 9 (supplement), S81 (1996).

Evans et al., "Efficacy of tumor necrosis factor binding protein (TNF-bp) in the streptococcal cell wall-induced reactivation model of arthritis," (Abstract No. 1540), Arthritis Rheum., vol. 39, No. 9 (supplement), S284 (1996).

(56) References Cited

OTHER PUBLICATIONS

Farr et al., "Sulphasalazine (SASP) in rheumatoid arthritis (RA): a 5 year prospective study," (Abstract No. 1519), Arthritis Rheum., vol. 39, No. 9 (supplement), S281 (1996).
Fiebich et al., "Effects of NSAIDs on IL-1-beta-induced IL-6 mRNA and protein synthesis in human astrocytoma cells," NeuroReport, vol. 7, 1209-1213 (1996).
Finnegan et al., "Leflunomide inhibits immunoglobulin production by two separate mechanisms," (Abstract No. 627), Arthritis Rheum., vol. 39, No. 9 (supplement), S131 (1996).
Guttadauria, M., "Tenidap in Rheumatoid Arthritis Collaborative International Study (TRACIS): a 6 month interim analysis," (Abstract No. 1516), Arthritis Rheum., vol. 39, No. 9 (supplement), 8280 (1996).
Hara et al., "Therapeutic effect of T-614, a new anti-arthritic agent, on rheumatoid arthritis," (Abstract No. 1526), Arthritis Rheum., vol. 39, No. 9 (supplement), S282 (1996).
Hickey et al., "The Rheumatoid Arthritis Azathioprine Registry (RAAR)—interim analysis of malignancy and mortality," (Abstract No. 1521), Arthritis Rheum., vol. 39, No. 9 (supplement), S281 (1996).
Kaine et al., "Results of a multi-dose protocol 7002 using an immunomodulating, non-depleting Primatized™ anti CD4 monoclonal antibody in rheumatoid arthritis (RA)," (Abstract No. 195), Arthritis Rheum., vol. 38, S185 (1995).
Kapadia et al, "Soluble TNF binding proteins modulate the negative inotropic properties of TNF alpha in vitro," Am. J. Physiol. 268 (Heart Circ. Physiol. 37): H517-H525 (1995).
Keith, Jr., et al., "Recombinant human interleukin eleven decreases arthritis in HLA B27 transgenic rats," (Abstract No. 1613), Arthritis Rheum., vol. 39, No. 9 (supplement), S296 (1996).
Lee et al., "Treatment of rheumatoid arthritis (RA) with thalidomide," (Abstract No. 1524), Arthritis Rheum., vol. 39, No. 9 (supplement), S282 (1996).
Lotz et al., "IL-17 promotes cartilage degradation," (Abstract No. 559), Arthritis Rheum., vol. 39, No. 9 (supplement), S120 (1996).
Martin, A.C.R., "Protein Sequence and Structure Analysis of Antibody Variable Domains," In Kontermann and Dübel, eds., Antibody Engineering (Springer-Verlag, Berlin, 2001), chapter 31, pp. 432-433.
Moreland et al., "Soluble tumor necrosis factor receptors (sTNFR): results of a phase I dose-escalation study in patients with rheumatoid arthritis," (Abstract No. 813), Arthritis Rheum., vol. 37, S295 (1994).
Moriuchi et al., "Treatment of established collagen-induced arthritis with PGE1 incorporated in lipid microspheres," (Abstract No. 1528), Arthritis Rheum., vol. 39, No. 9 (supplement), S282 (1996).
Ronday et al., "Tranexamic acid (TEA), an inhibitor of plasminogen activation, reduces collagen crosslink excretion in arthritis," (Abstract No. 1541), Arthritis Rheum., vol. 39, No. 9 (supplement), S284 (1996).
Ross, J.M., "Sulfasalazine (SSZ) toxicity: an assessment of American College of Rheumatology (ACR) monitoring guidelines for SSZ," (Abstract No. 1520), Arthritis Rheum., vol. 39, No. 9 (supplement), S281 (1996).
Scholz, P., "Inhibition of the production and effect of TNF-alpha by iloprost: possible impact for treatment of rheumatoid arthritis," (Abstract No. 336), Arthritis Rheum., vol. 39, No. 9 (supplement), S82 (1996).
Sewell et al., "DAB486IL-2 fusion toxin in refractory rheumatoid arthritis," Arthritis Rheum., vol. 36, No. 9, pp. 1223-1233 (Sep. 1993).
Stolk et al., "Are severe non-hematologic side-effects on azathioprine treatment caused by altered purine enzyme activities?" (Abstract No. 1522), Arthritis Rheum., vol. 39, No. 9 (supplement), S281 (1996).
Thoss et al., "Immunomodulation of rat antigen-induced arthritis by leflunomide alone and in combination with cyclosporin A," Inflamm. Res., vol. 45, 103-107 (1996).
Adamczyk and Mattingly, "Chemiluminescent N-Sulfonylacridinium-9-Carboxamides and Their Application in Clinical Assays," Chapter 5, In Luminescence Biotechnology: Instruments and Applications: (Van Dyke et al., eds.) (CRC Press LLC, Boca Raton, 2002) pp. 77-105.
Adamczyk et al., "Homogeneous chemiluminescent assays for free choline in human plasma and whole blood," Anal. Chim. Acta, 579(1): 61-67 (2006).
Adamczyk et al., "Linker-mediated modulation of the chemiluminescent signal from $N^{10}$-(3-sulfopropl)-N-sulfonylacridinium-9-carboxamide tracers," Bioconjugate Chem., 11: 714-724 (2000).
Adamczyk et al., "Chemiluminescent acridinium-9-carboxamide boronic acid probes: Application to a homogeneous glycated hemoglobin assay," Bioorg. Med. Chem. Lett., 16: 1324-1328 (2006).
Adamczyk et al., "Chemiluminescence quenching of pteroic acid-N-sulfonyl-acridinium-9-carboxamide conjugates by folate binding protein," Bioorg. Med. Chem. Lett., 14: 2313-2317 (2004).
Adamczyk et al., "Intrinsic factor-mediated modulation of cyanocobalamin-N-sulfonyl-acridinium-9-carboxamide chemiluminescence," Biorg. Med. Chem. Lett., 14: 3917-3921 (2004).
Adamczyk et al., "Neopentyl 3-triflyloxypropanesulfonate. A reactive sulfopropylation reagent for the preparation of chemiluminescent labels," J. Org. Chem., 63: 5636-5639 (1998).
Adamczyk et al., "Synthesis of a chemiluminescent acridinium hydroxylamine (AHA) for the direct detection of abasic sites in DNA," Org. Lett., 1: 779-781 (1999).
Adamczyk et al., "Regiodependent luminescence quenching of biotinylated N-sulfonyl-acridinium-9-carboxamides by avidin," Org. Lett., 5: 3779-3782 (2003).
Adamczyk et al., "Modulation of the chemiluminescent signal from $N^{10}$-(3-sulfopropyl)-N-sulfonylacridinium-9-carboxamides," Tetrahedron, 55: 10899-10914 (1999).
Aggarwal et al., "IL-17: prototype member of an emerging cytokine family," J. Leukoc. Biol., 71: 1-8 (2002).
Ames et al., "Conversion of murine Fabs isolated from a combinatorial phage display library to full length immunoglobulins," J. Immunol. Methods, 184: 177-186 (1995).
Anthony et al., "Recapitulation of IVIG anti-inflammatory activity with a recombinant IgG Fc," Science, 320: 373-376 (2008).
Aoki et al., "Endothelial Progenitor Cell Capture by Stents Coated with Antibody Against CD34," J. Am. Coll. Cardiol., 45(10): 1574-1579 (2005).
Arancio et al., "RAGE potentiates Aβ-induced perturbation of neuronal function in transgenic mice," EMBO J., 23: 4096-4105 (2004).
Attur et al., "Interleukin-17 up-regulation of nitric oxide production in human osteoarthritis cartilage," Arthritis Rheum., 40: 1050-1053 (1997).
Azzazy et al., "Phage display technology: clinical applications and recent innovations," Clin. Biochem., 35: 425-445 (2002).
Babcook et al., "A novel strategy for generating monoclonal antibodies from single, isolated lymphocytes producing antibodies of defined specificities," Proc. Natl. Acad. Sci. USA, 93: 7843-7848 (1996).
Barbas et al., "In vitro evolution of a neutralizing human antibody to human immunodeficiency virus type 1 to enhance affinity and broaden strain cross-reactivity," Proc. Natl. Acad. Sci. USA, 91: 3809-3813 (1994).
Better et al., "Escherichia coli Secretion of an Active Chimeric Antibody Fragment," Science, 240: 1041-1043 (1988).
Biewenga et al., "IgA1 half molecules in human multiple myeloma and the in vitro production of similar fragments from intact IgA1 molecules," Clin. Exp. Immunol., 51: 395-400 (1983).
Bird et al., "Single-Chain Antigen-Binding Proteins," Science, 242: 423-426 (1988).
Boado et al., "Fusion antibody for Alzheimer's Disease with bidirectional transport across the blood-brain barrier and Aβ fibril disaggregation," Bioconjug. Chem., 18(2): 447-455 (2007).
Bornemann et al., "Aβ-Induced Inflammatory Processes in Microglia Cells of APP23 Transgenic Mice," Am. J. Pathol., 158(1): 63-73 (2001).
Boyce et al., "No audible wheezing: nuggets and conundrums from mouse asthma models," J. Exp. Med., 201(12): 1869-1873 (2005).

(56) References Cited

OTHER PUBLICATIONS

Brand, D.D., "Rodent Models of Rheumatoid Arthritis," *Comparative Medicine*, 55(2): 114-122 (2005).
Brinkmann et al., "Phage display of disulfide-stabilized Fv fragments," *J. Immunol. Methods*, 182: 41-50 (1995).
Buchwald et al., "Long-term, continuous intravenous heparin administration by an implantable infusion pump in ambulatory patients with recurrent venous thrombosis," *Surgery*, 88: 507-516 (1980).
Buras et al., "Animal Models of Sepsis: Setting the Stage," *Nat. Rev. Drug. Discovery*, 4: 854-865 (2005).
Burke et al., "Zotarolimus (ABT-578) eluting stents," *Adv. Drug Del. Rev.*, 58: 437-446 (2006).
Burton et al., "Human Antibodies from Combinatorial Libraries," *Adv. Immunol.*, 57: 191-280 (1994).
Calandra et al., "Protection from septic shock by neutralization of macrophage migration inhibitory factor," *Nature Med.*, 6(2): 164-170 (2000).
Carter et al., "Humanization of an anti-p185$^{HER2}$ antibody for human cancer therapy," *Proc. Natl. Acad. Sci. USA*, 89: 4285-4289 (1992).
Chabaud et al., "Enhancing effect of IL-17 on IL-1-induced IL-6 and leukemia inhibitory factor production by rheumatoid arthritis synoviocytes and its regulation by Th2 cytokines," *J. Immunol.*, 161: 409-414 (1998).
Chabaud et al., "Enhancing effect of IL-1, IL-17, and TNF-α on macrophage inflammatory protein-3α production in rheumatoid arthritis: regulation by soluble receptors and Th2 cytokines," *J. Immunol.*, 167: 6015-6020 (2001).
Chakravarty et al., "Thermal ablation of tumor cells with antibody-functionalized single-walled carbon nanotubes," *Proc. Natl. Acad. Sci. USA*, 105: 8697-8702 (2008).
Chothia and Lesk, "Canonical Structures for the Hypervariable Regions of Immunoglobulins," *J. Mol. Biol.*, 196: 901-917 (1987).
Chothia et al., "Structural repertoire of the human V$^H$ segments," *J. Mol. Biol.*, 227: 799-817 (1992).
Chothia et al., "Conformations of immunoglobulin hypervariable regions," *Nature*, 342: 877-883 (1989).
Clackson et al., "Making antibody fragments using phage display libraries," *Nature*, 352: 624-628 (1991).
Cleek et al., "Biodegradable Polymeric Carriers for a bFGF Antibody for Cardiovascular Application," *Proceed. Intl. Symp. Control. Rel. Bioact. Mater.*, 24: 853-854 (1997).
Co et al., "Genetically Engineered Deglycosylation of the Variable Domain Increases the Affinity of an Anti-CD33 Monoclonal Antibody," *Mol. Immunol.*, 30(15): 1361-1367 (1993).
Coffman et al., "Nonhuman primate models of asthma," *J. Exp. Med.*, 201(12): 1875-1879 (2005).
Coloma et al., "Transport across the primate blood-brain barrier of a genetically engineered chimeric monoclonal antibody to the human insulin receptor," *Pharm Res.*, 17(3): 266-274 (2000).
Dall'Acqua et al., "Contribution of Domain Interface Residues to the Stability of Antibody $C_H3$ Domain Homodimers," *Biochemistry*, 37: 9266-9273 (1998).
Deane et al., "RAGE mediates amyloid-β peptide transport across the blood-brain barrier and accumulation in brain," *Nature Med.*, 9(7): 907-913 (2003).
Descotes J., "Immunotoxicology of Immunomodulators," *Develop. Biol. Standard*, 77: 99-102 (1992).
Dickson, B.J., "Molecular Mechanisms of Axon Guidance," *Science*, 298: 1959-1964 (2002).
Domeniconi et al., "Overcoming inhibitors in myelin to promote axonal regeneration," *J. Neurological Sciences*, 233: 43-47 (2005).
During et al., "Controlled Release of Dopamine from a Polymeric Brain Implant: In Vivo Characterization," *Ann. Neurol.*, 25(4): 351-356 (1989).
Foote and Winter, "Antibody framework residues affecting the conformation of the hypervariable loops," *J. Mol. Biol.*, 224: 487-499 (1992).
Fossiez et al., "T cell interleukin-17 induces stromal cells to produce proinflammatory and hematopoietic cytokines," *J. Exp. Med.*, 183(6): 2593-2603 (1996).

Fuchs et al., "Targeting Recombinant Antibodies to the Surface of Escherichia coli: Fusion to a Peptidoglycan Associated Lipoprotein," *Bio/Technology*, 9: 1369-1372 (1991).
Garrard et al., "$F_{AB}$ Assembly and Enrichment in a Monovalent Phage Display System," *Bio/Technology*, 9: 1373-1377 (1991).
Gavilondo and Larrick, "Antibody Engineering at the Millennium," *BioTechniques*, 29: 128-145 (2000).
Genain et al., "Creation of a model for multiple sclerosis in *Callithrix jacchus* marmosets," *J. Mol. Med.*, 75(3): 187-197 (1997).
Genovese et al., "Abatacept for Rheumatoid Arthritis Refractory to Tumor Necrosis Factor α Inhibition," *N. Engl. J. Med.*, 353: 1114-1123 (2005).
Gillies et al., "High-level expression of chimeric antibodies using adapted cDNA variable region cassettes," *J. Immunol. Methods*, 125: 191-202 (1989).
Goldspiel et al., "Human Gene Therapy," *Clin. Pharm.*, 12: 488-505 (1993).
Gram et al., "In vitro selection and affinity maturation of antibodies from a naive combinatorial immunoglobulin library," *Proc. Natl. Acad. Sci. USA*, 89: 3576-3580 (1992).
Green et al., "Antigen-specific human monoclonal antibodies from mice engineered with human Ig heavy and light chain YACs," *Nature Genetics*, 7: 13-21 (1994).
Green and Jakobovits, "Regulation of B Cell Development by Variable Gene Complexity in Mice Reconstituted with Human Immunoglobulin Yeast Artificial Chromosomes," *J. Exp. Med.*, 188(3): 483-495 (1998).
Griffiths et al., "Human anti-self antibodies with high specificity from phage display libraries," *EMBO J.*, 12(2): 725-734 (1993).
Harriman et al., "Summary of clinical trials in rheumatoid arthritis using infliximab, an anti-TNFα treatment," *Ann. Rheum. Dis.*, 58: (Suppl. I) 61-64 (1999).
Hart et al., "Preclinical efficacy and safety of mepolizumab (SB-240563), a humanized monoclonal antibody to IL-5, in cynomolgus monkeys," *J. Allergy Clin. Immunol.*, 108(2): 250-257 (2001).
Hawkins et al., "Selection of Phage Antibodies by Binding Affinity Mimicking Affinity Maturation," *J. Mol. Biol.*, 226: 889-896 (1992).
Hay et al., "Bacteriophage cloning and *Escherichia coli* expression of a human IgM Fab," *Hum. Antibod. Hybridomas*, 3: 81-85 (1992).
Hildebrand et al., "Surface coatings for biological activation and functionalization of medical devices," *Surface & Coatings Technology*, 200: 6318-6324 (2006).
Holliger et al., "'Diabodies': Small bivalent and bispecific antibody fragments," *Proc. Natl. Acad. Sci. USA*, 90: 6444-6448 (1993).
Hoogenboom et al., "Multi-subunit proteins on the surface of filamentous phage: methodologies for displaying antibody (Fab) heavy and light chains," *Nucl. Acids Res.*, 19(15): 4133-4137 (1991).
Hoogenboom et al., "Natural and designer binding sites made by phage display technology," *Immunology Today*, 21(8): 371-378 (2000).
Hoogenboom, H.R., "Designing and optimizing library selection strategies for generating high-affinity antibodies," *Trends Biotechnol.*, 15: 62-70 (1997).
Howard et al., "Intracerebral drug delivery in rats with lesion-induced memory deficits," *J. Neurosurg.*, 71: 105-112 (1989).
Huber et al., "Crystallographic structure studies of an IgG molecule and an Fc fragment," *Nature*, 264: 415-420 (1976).
Huse et al., "Generation of a Large Combinatorial Library of the Immunoglobulin Repertoire in Phage Lambda," *Science*, 246: 1275-1281 (1989).
Huston, et al., "Protein engineering of antibody binding sites: Recovery of specific activity in an anti-digoxin single-chain Fv analogue produced in *Escherichia coli*," *Proc. Natl. Acad. Sci. USA*, 85: 5879-5883 (1988).
Huston, et al., "Protein Engineering of Single-Chain Fv Analogs and Fusion Proteins," *Methods Enzymol.*, 203: 46-88 (1991).
Jackson et al., "In Vitro Antibody Maturation, Improvement of a High Affinity, Neutralizing Antibody Against IL-1β," *J. Immunol.*, 154(7): 3310-3319 (1995).
Janelsins et al., "Early correlation of microglial activation with enhanced tumor necrosis factor-α and monocyte chemoattractant

(56) References Cited

OTHER PUBLICATIONS protein-I expression specifically within the entorhinal cortex of triple transgenic Alzheimer's disease mice," *J. Neuroinflammation*, 2(23): 1-12 (2005).
Jefferis, R., "Glycosylation of Recombinant Antibody Therapuetics," *Biotechnol. Prog.*, 21: 11-16 (2005).
Johnsson et al., "Immobilization of Proteins to a Carboxymethyldextran-Modified Gold Surface for Biospecific Interaction Analysis in Surface Plasmon Resonance Sensors," *Anal. Biochem.*, 198: 268-277 (1991).
Johnsson et al., "Comparison of Methods for Immobilization to Carboxymethyl Dextran Sensor Surfaces by Analysis of the Specific Activity of Monoclonal Antibodies," *J. Mol. Recognit.*, 8: 125-131 (1995).
Joliot et al., "Antennapedia homeobox peptide regulates neural morphogenesis," *Proc. Natl. Acad. Sci. USA*, 88: 1864-1868 (1991).
Jones et al., "Replacing the complementarity-determining regions in a human antibody with those from a mouse," *Nature*, 321: 522-525 (1986).
Jönsson, et al., "Real-Time Biospecific Interaction Analysis Using Surface Plasmon Resonance and a Sensor Chip Technology," *Biotechniques*, 11(5): 620-627 (1991).
Jönsson et al., "Introducing a biosensor based technology for real-time biospecific interaction analysis," *Ann. Biol. Clin.*, 51: 19-26 (1993).
Jovanovic et al., "IL-17 stimulates the production and expression of proinflammatory cytokines, IL-β and TNA-α, by human macrophages," *J. Immunol.*, 160: 3513-3521 (1998).
Jungbluth et al., "A monoclonal antibody recognizing human cancers with amplification/overexpression of the human epidermal growth factor receptor," *Proc. Natl. Acad. Sci. USA*, 100(2): 639-644 (2003).
Karnezis et al., "The neurite outgrowth inhibitor Nogo A is involved in autoimmune-mediated demyelination," *Nature Neurosci.*, 7: 736 (2004).
Kaufman and Sharp, "Amplification and expression of sequences cotransfected with a modular dihydrofolate reductase complementary DNA gene," *J. Mol. Biol.*, 159(4): 601-621 (1982).
Kawaguchi et al., "IL-17 cytokine family," *J. Allergy Clin. Immunol.*, 114(6): 1267-1273 (2004).
Kellermann et al., "Antibody discovery: the use of transgenic mice to generate human monoclonal antibodies for therapeutics," *Curr. Opin. Biotechnol.*, 13: 593-597 (2002).
Kettleborough et al., "Humanization of a mouse monoclonal antibody by CDR-grafting: the importance of framework residues on loop conformation," *Protein Eng.*, 4(7): 773-783 (1991).
Kettleborough et al., "Isolation of tumor cell-specific single-chain Fv from immunized mice using phage-antibody libraries and the reconstruction of whole antibodies from these antibody fragments," *Eur. J. Immunol.*, 24: 952-958 (1994).
Kim et al., "Identifying amino acid residues that influence plasma clearance of murine IgG1 fragments by site-directed mutagenesis," *Eur. J. Immunol.*, 24: 542-548 (1994).
Kipriyanov et al., "Recombinant single-chain Fv fragments carrying C-terminal cysteine residues: Production of bivalent and biotinylated miniantibodies," *Mol. Immunol.*, 31: 1047-1058 (1994).
Kipriyanov et al., "Single-chain antibody streptavidin fusions: Tetrameric bifunctional scFv-complexes with biotin binding activity and enhanced affinity to antigen," *Hum. Antibod. Hybridomas*, 6: 93-101 (1995).
Kirkham et al., "Synovial membrane cytokine expression is predictive of joint damage progression in rheumatoid arthritis," *Arthritis Rheum.*, 54: 1122-1131 (2006).
Klein, W. L., "Aβ toxicity in Alzheimer's disease: globular oligomers (ADDLs) as new vaccine and drug targets," *Neurochem. Int.*, 41: 345-352 (2002).
Klyubin et al., "Amyloid β protein immunotherapy neutralizes Aβ oligomers that disrupt synaptic plasticity in vivo," *Nature Med.*, 11: 556-561 (2005).
Kohno et al., "Interleukin-17 gene expression in patients with rheumatoid arthritis," *Mod. Rheumatol.*, 18: 15-22 (2008).
Kolls et al., "Interleukin-17 family members and inflammation," *Immunity*, 21: 467-476 (2004).
Kyte et al., "A simple method for displaying the hydropathic character of a protein," *J. Mol. Biol.*, 157: 105-132 (1982).
Lam et al., "Microencapsulation of Recombinant Humanized Monoclonal Antibody for Local Delivery," *Proceed. Intl Symp. Control Rel. Bioact. Mater.*, 24: 759-760 (1997).
Langer et al., "Chemical and Physical Structure of Polymers as Carriers for Controlled Release of Bioactive Agents: A Review," *J. Macromol. Sci. Rev. Macromol. Chem. Phys.*, C23(1): 61-126 (1983).
Langer, R., "New Methods of Drug Delivery," *Science*, 249: 1527-1533 (1990).
LeGrand et al., "Interleukin-1, tumor necrosis factor α, and interleukin-17 synergistically up-regulate nitric oxide and prostaglandin $E_2$ production in explants of human osteoarthritic knee menisci," *Arthritis Rheum.*, 44: 2078-2083 (2001).
Levy et al., "Inhibition of Calcification of Bioprosthetic Heart Valves by Local Controlled-Release Diphosphonate," *Science*, 228: 190-192 (1985).
Little et al., "Of mice and men: hybridoma and recombinant antibodies," *Immunol. Today*, 21(8): 364-370 (2000).
Lloyd et al., "Mouse Models of Allergic Airway Disease," *Adv. Immunol.*, 77: 263-295 (2001).
Lubberts et al., "Treatment with a neutralizing anti-murine interleukin-17 antibody after the onset of collagen-induced arthritis reduces joint inflammation, cartilage destruction, and bone erosion," *Arthritis Rheum.*, 50: 650-659 (2004).
Lublin, F.D., "Relapsing Experimental Allergic Encephalomyelitis an Autoimmune Model of Multiple Sclerosis," *Springer Semin. Immunopathol.*, 8: 197-208 (1985).
Luster et al., "Use of animal studies in risk assessment for immunotoxicology," *Toxicology*, 92(1-3): 229-243 (1994).
MacCallum et al., "Antibody-antigen Interactions: Contact Analysis and Binding Site Topography," *J. Mol. Biol.*, 262: 732-745 (1996).
Makwana et al., "Molecular mechanisms in successful peripheral regeneration," *FEBS J.*, 272: 2628-2638 (2005).
Marchalonis et al., "Evolutionary Factors in the Emergence of the Combinatorial Germline Antibody Repertoire," *Adv. Exp. Med. Biol.*, 484: 13-30 (2001).
Marks et al., "By-Passing Immunization: Building High Affinity Human Antibodies by Chain Shuffling," *BioTechnology*, 10: 779-783 (1992).
Marques et al., "Mediation of the Cytokine Network in the Implantation of Orthopedic Devices," Chapter 21, In *Biodegradable Systems in Tissue Engineering and Regenerative Medicine*, (Reis et al., eds.) (CRC Press LLC, Boca Raton, 2005) pp. 377-397.
Masliah et al., "Effects of α-Synuclein Immunization in a Mouse Model of Parkinson's Disease," *Neuron*, 46: 857-868 (2005).
Mateo et al., "Humanization of a mouse monoclonal antibody that blocks the epidermal growth factor receptor: recovery of antagonistic activity," *Immunotechnology*, 3: 71-81 (1997).
Mattingly, P.G., "Chemiluminescent 10-methyl-acridinium-9-(N-sulphonylcarboxamide) salts. Synthesis and kinetics of light emission," *J. Biolumin. Chemilumin.*, 6: 107-114 (1991).
McCafferty et al., "Phage antibodies: filamentous phage displaying antibody variable domains," *Nature*, 348: 552-554 (1990).
McCapra et al., "Chemiluminescence involving peroxide decompositions," *Photochem. Photobiol.*, 4: 1111-1121 (1965).
McGee et al., "The Nogo-66 receptor: focusing myelin inhibition of axon regeneration," *Trends Neurosciences*, 26(4): 193-198 (2003).
Mendez et al., "Functional transplant of megabase human immunoglobulin loci recapitulates human antibody response in mice," *Nature Genet.*, 15: 146-156 (1997).
Milstein and Cuello, "Hybrid hybridomas and their use in immunohistochemistry," *Nature*, 305: 537-540 (1983).
Modjtahedi et al., "Antitumor Activity of Combinations of Antibodies Directed Against Different Epitopes on the Extracellular Domain of the Human EGF Receptor," *J. Cell Biophys.*, 22(1-3): 129-146 (1993).
Modjtahedi et al., "The human EGF receptor as a target for cancer therapy: six new rat mAbs against the receptor on the breast carcinoma MDA-MB 468," *Br. J. Cancer*, 67: 247-253 (1993).

(56) References Cited

OTHER PUBLICATIONS

Modjtahedi et al., "Phase I trial and tumour localisation of the anti-EGFR monoclonal antibody 1CR62 in head and neck or lung cancer," *Br. J. Cancer*, 73: 228-235 (1996).

Modjtahedi et al., "Targeting of Cells Expressing Wild-Type EGFR and Type-III Mutant EGFR (EGFRVIII) by Anti-EGFR MAB ICR62: A Two-Pronged Attack for Tumour Therapy," *Int. J. Cancer*, 105: 273-280 (2003).

Morgan and Anderson, "Human Gene Therapy," *Ann. Rev. Biochem.*, 62: 191-217 (1993).

Morrison et al., "Chimeric human antibody molecules: Mouse antigen-binding domains with human constant region domains," *Proc. Natl. Acad. Sci. USA*, 81: 6851-6855 (1984).

Morrison, S.L., "Transfectomas provide novel chimeric antibodies," *Science*, 229: 1202-1207 (1985).

Moseley et al., "Interleukin-17 family and IL-17 receptors," *Cytokine Growth Factor Rev.*, 14(2): 155-174 (2003).

Mulligan, R.C., "The Basic Science of Gene Therapy," *Science*, 260: 926-932 (1993).

Mullinax et al., "Expression of a Heterodimeric Fab Antibody Protein in One Cloning Step," *BioTechniques*, 12(6): 864-869 (1992).

Murthy et al., "Binding of an Antagonistic Monoclonal Antibody to an Intact and Fragmented EGF-Receptor Polypeptide," *Arch. Biochem. Biophys.*, 252(2): 549-560 (1987).

Nelson, R.B., "The Dualistic Nature of Immune Modulation in Alzheimer's Disease: Lessons from the Transgenic Models," *Curr. Pharm. Des.*, 11: 3335-3352 (2005).

Neuberger et al., "Recombinant antibodies possessing novel effector functions," *Nature*, 312: 604-608 (1984).

Ning et al., "Intratumoral radioimmunotherapy of a human colon cancer xenograft using a sustained-release gel," *Radiotherapy Oncol.*, 39: 179-189 (1996).

Oi et al., "Chimeric Antibodies," *BioTechniques*, 4: 214-221 (1986).

Okamoto et al., "Rituximab for Rheumatoid Arthritis," *N. Engl. J. Med.*, 351: 1909 (2004).

Owens et al., "The Immunology of Multiple Sclerosis and its Animal Model, Experimental Allergic Encephalomyelitis," *Neurol. Clin.*, 13(1): 51-73 (1995).

Padlan, E., "A Possible Procedure for Reducing the Immunogenicity of Antibody Variable Domains While Preserving Their Ligand-Binding Properties," *Mol. Immunol.*, 28(4/5): 489-498 (1991).

Padlan et al., "Identification of specificity-determining residues in antibodies," *FASEB J.*, 9: 133-139 (1995).

Peng, S.L., "Experimental Use of Murine Lupus Models," *Methods Mol. Med.*, 102: 227-272 (2004).

Persic et al., "An integrated vector system for the eukaryotic expression of antibodies or their fragments after selection from phage display libraries," *Gene*, 187: 9-18 (1997).

Poljak, R.J., "Production and structure of diabodies," *Structure*, 2: 1121-1123 (1994).

Presta et al., "Humanization of an Antibody Directed Against IgE," *J. Immunol.*, 151(5): 2623-2632 (1993).

Presta, L.G., "Selection, design, and engineering of therapeutic antibodies," *J. Allergy Clin. Immunol.*, 116: 731-736 (2005).

Razavi et al., "Stable and versatile active acridinium esters I," *Luminescence*, 15: 239-244 (2000).

Razavi et al., "Stable and versatile active acridinium esters II," *Luminescence*, 15: 245-249 (2000).

Riechmann et al., "Reshaping human antibodies for therapy," *Nature*, 332: 323-327 (1988).

Roberts and Szostak, "RNA-peptide fusions for the in vitro selection of peptides and proteins," *Proc. Natl. Acad. Sci. USA*, 94: 12297-12302 (1997).

Rodeck et al., "Interations Between Growth Factor Receptors and Corresponding Monoclonal Antibodies in Human Tumors," *J. Cell. Biochem.*, 35: 315-320 (1987).

Roguska et al., "Humanization of murine monoclonal antibodies through variable domain resurfacing," *Proc. Natl. Acad. Sci. USA*, 91: 969-973 (1994).

Rouvier et al., "CTLA-8, cloned from an activated T cell, bearing AU-rich messenger RNA instability sequences, and homologous to a herpesvirus *Saimiri* gene," *J. Immunol.*, 150 5445-5456 (1993).

Saudek et al., "A Preliminary Trial of the Programmable Implantable Medication System for Insulin Delivery," *N. Engl. J. Med.*, 321: 574-579 (1989).

Sawai et al., "Direct Production of the Fab Fragment Derived From the Sperm immobilizing Antibody Using Polymerase Chain Reaction and cDNA Expression Vectors," *Am, J. Reprod. Immunol.*, 34: 26-34 (1995).

Schier et al., "Identification of functional and structural amino-acid residues by parsimonious mutagenesis," *Gene*, 169: 147-155 (1995).

Sefton, M.V., "Implantable Pumps," *CRC Crit. Rev. Biomed. Eng.*, 14(3): 201-240 (1987).

Seligmann et al., "Immunochemical Study of a Human Myeloma IgG1 Half Molecule," *Ann. Immunol.*, 129 C: 855-870 (1978).

Sfikakis et al., "Rituximab anti-B-cell therapy in systemic lupus erythematosus: pointing to the future," *Curr. Opin. Rheumatol.*, 17: 550-557 (2005).

Shalom-Barak et al., "Interleukin-17-induced gene expression in articular chondrocytes is associated with activation of mitogen-activated protein kinases and NF-κB," *J. Biol. Chem.*, 273: 27467-27473 (1998).

Shapiro et al., "DNA Target Motifs of Somatic Mutagenesis in Antibody Genes," *Crit. Rev. Immunol.*, 22(3): 183-200 (2002).

Shields et al., "Lack of Fucose on Human IgG1 N-Linked Oligosaccharide Improves Binding to Human FcγRIII and Antibody-dependent Cellular Toxicity," *J. Biol. Chem.*, 277(30): 26733-26740 (2002).

Shu et al., "Secretion of a single-gene-encoded immunoglobulin from myeloma cells," *Proc. Natl. Acad. Sci. USA*, 90: 7995-7999 (1993).

Sims et al., "A Humanized CD18 Antibody Can Block Function without Cell Destruction," *J. Immunol.*, 151(4): 2296-2308 (1993).

Skerra et al., "Assembly of a Functional Immunoglobulin Fv Fragment in *Escherichia coli*," *Science*, 240: 1038-1041 (1988).

Snibson et al., "Airway remodelling and inflammation in sheep lungs after chronic airway challenge with house dust mite," *Clin. Exp. Allergy*, 35: 146-152 (2005).

Soderlind et al., "Recombining germline-derived CDR sequences for creating diverse singleframework antibody libraries," *Nature Biotechnol.*, 18: 852-856 (Aug. 2000).

Soloman, B., "Alzheimer's Disease and Immunotherapy," *Curr. Alzheimer. Res.*, 1: 149-163 (2004).

Song et al., "Antibody Mediated Lung Targeting of Long-Circulating Emulsions," *PDA J. Pharm. Sci. Technol.*, 50: 372-377 (1996).

Spriggs, M.K., "Interleukin-17 and its receptor," *J. Clin. Immunol.*, 17: 366-369 (1997).

Staerz et al., "Hybrid antibodies can target sites for attack by T cells," *Nature*, 314: 628-631 (1985).

Steinman et al., "Virtues and pitfalls of EAE for the development of therapies for multiple sclerosis," *Trends Immunol.*, 26(11): 565-571 (2005).

Studnicka et al., "Human-engineered monoclonal antibodies retain full specific binding activity by preserving non-CDR complementarity-modulating residues," *Protein Eng.*, 7(6): 805-814 (1994).

't Hart et al., "Suppression of Ongoing Disease in a Nonhuman Primate Model of Multiple Sclerosis by a Human-Anti-Human IL-12p40 Antibody," *J. Immunol.*, 175(7): 4761-4768 (2005).

Takeda et al., "Construction of chimaeric processed immunoglobulin genes containing mouse variable and human constant region sequences," *Nature*, 314: 452-454 (1985).

Taylor et al., "A transgenic mouse that expresses a diversity of human sequence heavy and light chain immunoglobulins," *Nucl. Acids Res.*, 20: 6287-6295 (1992).

Teng et al., "Nogo Signaling and Non-Physical Injury-Induced Nervous System Pathology," *J. Neuroscience Research*, 79: 273-278 (2005).

Teunissen et al., "Interleukin-17 and interferon-γ synergize in the enhancement of proinflammatory cytokine production by human keratinocytes," *J. Investig. Dermatol.*, 111: 645-649 (1998).

(56) References Cited

OTHER PUBLICATIONS

Thies et al., "Folding and Association of the Antibody Domain $C_H3$: Prolyl Isomerization Preceeds Dimerization," *J. Mol. Biol.*, 293: 67-79 (1999).
Tolstoshev, P., "Gene Therapy, Concepts, Current Trials and Future Directions," *Ann. Rev. Pharmacol. Toxicol.*, 32: 573-596 (1993).
Tuohy et al., "Spontaneous Regression of Primary Autoreactivity during Chronic Progression of Experimental Autoimmune Encephalomyelitis and Multiple Sclerosis," *J. Exp. Med.*, 189(7): 1033-1042 (1999).
Umaña et al., "Engineered glycoforms of an antineuroblastoma IgG1 with optimized antibody-dependent cellular cytotoxic activity," *Nature Biotechnol.*, 17: 176-180 (1999).
Urlaub and Chasin, "Isolation of Chinese hamster cell mutants deficient in dihydrofolate reductase activity," *Proc. Natl. Acad. Sci. USA*, 77: 4216-4220 (1980).
van Bezooijen et al., "Interleukin 17 synergises with tumour necrosis factor a to induce cartilage destruction in vitro," *Ann. Rheum. Dis.*, 61: 870-876 (2002).
van den Berg, W.B., "Anti-cytokine therapy in chronic destructive arthritis," *Arthritis Res.*, 3: 18-26 (2001).
Verhoeyen et al., "Reshaping Human Antibodies: Grafting an Antilysozyme Activity," *Science*, 239: 1534-1536 (1988).
von Mehren et al., "Monoclonal Antibody Therapy for Cancer," *Ann. Rev. Med.*, 54: 343-369 (2003).
Wallemacq et al., "Evaluation of the new AxSYM cyclosporine assay: Comparison with TDx monoclonal whole blood and Emit cyclosporine assays," *Clin. Chem.* 45: 432-435 (1999).
Wallick et al., "Glycosylation of a $V_H$ Residue of a Monoclonal Antibody Against α(1→6) Dextran Increases its Affinity for Antigen," *J. Exp. Med.*, 168: 1099-1109 (1988).
Ward et al., "Binding activities of a repertoire of single immunoglobulin variable domains secreted from *Escheria coli*," *Nature*, 341: 544-546 (1989).
West et al., "Crystal Structure and Immunoglobulin G Binding Properties of the Human Major Histocompatibility Complex-Related Fc Receptor," *Biochemistry*, 39: 9698-9708 (2000).
Wright et al., "Antibody variable region glycosylation: position effects on antigen binding and carbohydrate structure," *EMBO J.*, 10(10): 2717-2723 (1991).
Wu and Wu, "Delivery systems for gene therapy," *Biotherapy*, 3: 87-95 (1991).
Wu and Wu, "Receptor-mediated in vitro Gene Transformation by a Soluble DNA Carrier System," *J. Biol. Chem.*, 262(10): 4429-4432 (1987).
Wu et al., "Drug/device combinations for local drug therapies and infection prophylaxis," *Biomaterials*, 27: 2450-2467 (2006).
Wu et al., "Simultaneous targeting of multiple disease mediators by a dual-variable-domain immunoglobulin," *Nature Biotechnology* (advance online publication), 2007 Nature Publishing Group, 1-8 (http://www.nature.com/naturebiotechnology) published online Oct. 14, 2007.
Xu, Gang, et al., "Recombinant DNA vaccine encoding multiple domains related to inhibition of neurite outgrowth: a potential strategy for axonal regeneration," *J. Neurochem.*, 91: 1018-1023 (2004).
Yang et al., "CDR walking mutagenesis for the affinity maturation of a potent human anti-HIV-1 antibody into the picomolar range," *J. Mol. Biol.*, 254: 392-403 (1995).
Yao et al., "Herpesvirus *Saimiri* encodes a new cytokine, IL-17, which binds to a novel cytokine receptor," *Immunity*, 3: 811-821 (1995).
Yao et al., "Human IL-17: a novel cytokine derived from T cells," *J. Immunol.*, 155(12): 5483-5486 (1995).
Yao et al., "Molecular characterization of the human interleukin (IL)-17 receptor," *Cytokine*, 9: 794-800 (1997).
Yatscoff et al., "Abbott TDx Monoclonal Antibody Assay Evaluated for Measuring Cyclosporine in Whole Blood," *Clin. Chem.*, 36: 1969-1973 (1990).
Yelton et al., "Affinity Maturation of the BR96 Anti-Carcinoma Antibody by Codon-Based Mutagenesis," *J. Immunol.*, 155: 1994-2004 (1995).
Yonehara et al., "Involvement of apoptosis antigen Fas in clonal deletion of human thymocytes," *Int. Immunol.*, 6(12): 1849-1856 (1994).
Zapata et al., "Engineering linear F(ab')$_2$ fragments for efficient production in *Escherichia coli* and enhanced antiproliferative activity," *Protein Eng.*, 8(10): 1057-1062 (1995).
International Search Report, Sep. 27, 2010, issued in PCT/US2010/026424.
Written Opinion, Sep. 27, 2010, issued in PCT/US2010/026424.
R&D Systems: "Monoclonal Anti-human IL-17 Antibody," Announcement R&D Systems, Jan. 11, 2004, pp. 1-2.
EPO Communication dated Jan. 28, 2013, enclosing Extended European Search Report, which includes (pursuant to Rule 62 EPC) the supplementary European search report, and the European search opinion dated Jan. 18, 2013, issued in corresponding EP Application No. 10 749 415.5.
International Preliminary Report on Patentability (IPRP), dated Feb. 4, 2011, issued in PCT/US2010/026424.

* cited by examiner

IL-17 BINDING PROTEINS

REFERENCE TO RELATED APPLICATIONS

This application is a non-provisional application claiming the benefit of U.S. Provisional Application No. 61/209,272, filed Mar. 5, 2009.

FIELD OF THE INVENTION

The present invention relates to IL-17 binding proteins, and specifically to their uses in the prevention and/or treatment of acute and chronic immunological diseases such as rheumatoid arthritis, osteoarthritis, psoriasis, multiple sclerosis, and other autoimmune diseases.

BACKGROUND OF THE INVENTION

Interleukin-17A (IL-17A, synonymous with IL-17) is a cytokine produced from the TH17 lineage of T cells. IL-17 was originally designated "CTL-associated antigen 8" (CTLA-8) when cloned from a rodent T cell hybridoma and identified as a protein having amino acid sequence homology with the thirteenth open frame (ORF-13) of herpesvirus saimiri, a γ herpes virus that causes T cell lymphoma in monkeys and rabbits (Rouvier et al., *J. Immunol.*, 150 5445-5556 (1993); Yao et al., *Immunity*, 3: 811-821 (1995)). The human equivalent of CTLA-8 was later cloned and designated "IL-17" (Yao et al., *J. Immunol.*, 155(12): 5483-5486 (1995); Fossiez et al., *J. Exp. Med.*, 183(6): 2593-2603 (1996)). The human gene for IL-17 encodes a 155 amino acid polypeptide comprising a 19 amino acid signal sequence and a 132 amino acid mature domain.

Human IL-17A is a glycoprotein with a $M_r$ of 17,000 daltons (Spriggs et al., *J. Clin. Immunol.*, 17: 366-369 (1997)). IL-17A may exist as either a homodimer or as a heterodimer complexed with the homolog IL-17F to form heterodimeric IL-17A/F. IL-17F (IL-24, ML-1) shares a 55% amino acid identity with IL-17A. IL-17A and IL-17F also share the same receptor (IL-17R), which is expressed on a wide variety of cells including vascular endothelial cells, peripheral T cells, B cells, fibroblast, lung cells, myelomonocytic cells, and marrow stromal cells (Kolls et al., *Immunity*, 21: 467-476 (2004); Kawaguchi et al., *J. Allergy Clin. Immunol.*, 114(6): 1267-1273 (2004); Moseley et al., *Cytokine Growth Factor Rev.*, 14(2): 155-174 (2003)). Additional IL-17 homologs have been identified (IL-17B, IL-17C, IL-17D, IL-E). These other family members share less than 30% amino acid identity with IL-17A (Kolls et al., 2004).

IL-17A is involved in the induction of proinflammatory responses and induces or mediates expression of a variety of other cytokines, factors, and mediators including tissue necrosis factor-alpha (TNF-α), IL-6, IL-8, IL-1β, granulocyte colony-stimulating factor (G-CSF), prostaglandin $E_2$ (PGE$_2$), IL-10, IL-12, IL-1R antagonist, leukemia inhibitory factor, and stromelysin (Yao et al., *J. Immunol.*, 155(12): 5483-5486 (1995); Fossiez et al., *J. Exp. Med.*, 183(6): 2593-2603 (1996); Jovanovic et al., *J. Immunol.*, 160: 3513-3521 (1998); Teunissen et al., *J. Investig. Dermatol.*, 111: 645-649 (1998); Chabaud et al., *J. Immunol.*, 161: 409-414 (1998)). IL-17 also induces nitric oxide in chondrocytes and in human osteoarthritis explants (Shalom-Barak et al., *J. Biol. Chem.*, 273: 27467-27473 (1998); Attur et al., *Arthritis Rheum.*, 40: 1050-1053 (1997)).

Through its role in T cell mediated autoimmunity, IL-17 induces the release of cytokines, chemokines, and growth factors (as noted above), is an important local orchestrator of neutrophil accumulation, and plays a role in cartilage and bone destruction. There is growing evidence that targeting IL-17 signaling might prove useful in a variety of autoimmune diseases including rheumatoid arthritis (RA), psoriasis, Crohn's disease, multiple sclerosis (MS), psoriatric disease, asthma, and lupus (SLE) (see, e.g., Aggarwal et al., *J. Leukoc. Biol.*, 71(1): 1-8 (2002); Lubberts et al., "Treatment with a neutralizing anti-murine interleukin-17 antibody after the onset of collagen-induced arthritis reduces joint inflammation, cartilage destruction, and bone erosion," *Arthritis Rheum.*, 50: 650-659 (2004)).

The pathogenic role of TNF in arthritis is well established as TNF-α antagonists reduce inflammation and limit progression of cartilage damage and bone erosion in human disease (van den Berg. "Anti-cytokine therapy in chronic destructive arthritis," *Arthritis Res.*, 3: 18-26 (2001)). Although TNF antagonists have revolutionized RA therapy, a significant portion of patients do not respond adequately to these drugs. Preclinical studies with TNF-α and IL-17 point to both independent and overlapping roles in arthritis pathophysiology. Whereas IL-17 or TNF-α alone exert only modest effects on proinflammatory gene expression, the combination of IL-17 with TNF-α leads to strong synergistic responses. This synergy results in upregulation of cytokines (LeGrand et al., *Arthritis Rheum.*, 44: 2078-2083 (2001)) and proinflammatory chemokines (Chabaud et al., *J. Immunol.*, 167: 6015-6020 (2001)) and also in the induction of cartilage and bone destruction (Van Bezooijen et al., *Ann. Rheum. Dis.*, 61: 870-876 (2002)). Interaction between TNF-α and IL-17 has been demonstrated as a predicting factor for joint damage progression in humans in a two-year prospective study of RA patients (Kirkham et al., *Arthritis Rheum.*, 54: 1122-1131 (2006)). In addition, IL-17 mRNA levels correlate poorly with TNF-α expression in RA, indicating that IL-17 blockade might complement TNF-α antagonists for optimal treatment of RA (Kohno et al., *Mod. Rheumatol.*, 18: 15-22 (2008)).

Although a variety of antibodies to IL-17 have been described in the nearly two decades of work since the discovery of this critical proinflammatory cytokine, there remains a need for improved antibodies that can effectively mediate or neutralize the activity of IL-17 in the inflammatory response and autoimmune disorders.

SUMMARY OF THE INVENTION

This invention pertains to proteins that bind human IL-17 (same as "IL-17A"). Binding proteins of the invention include but are not limited to antibodies, antigen binding portions thereof, and multivalent, multispecific binding proteins such as DVD-Ig™ binding proteins that can bind human IL-17 and another target, such as TNF-α. The invention also provides methods of making and using the IL-17 binding proteins described herein as well as various compositions that may be used in methods of detecting IL-17 in a sample or in methods of treating or preventing a disorder in an individual that is associated with or suspected to be associated with IL-17 activity. Binding proteins described herein may bind human IL-17A homodimer and/or heterodimers of IL-17A and the IL-17F homolog.

In one aspect of the invention, there is provided a binding protein comprising an antigen binding domain capable of binding human IL-17, said antigen binding domain comprising at least one CDR comprising an amino acid sequence selected from the group consisting of:

CDR-H1. $X_1$-$X_2$-$X_3$-$X_4$-$X_5$ (SEQ ID NO:919), wherein;
  $X_1$ is D or S;
  $X_2$ is Y;

X₃ is E or G;
X₄ is I, M, V, or F;
X₅ is H;
CDR-H2. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$ (SEQ ID NO:920), wherein;
X₁ is V;
X₂ is T, I, or N;
X₃ is D, H, or W;
X₄ is P or is not present;
X₅ is E, G, or S;
X₆ is S, N, or D;
X₇ is G;
X₈ is G or T;
X₉ is T;
X₁₀ is L, A, T, or F;
X₁₁ is H or Y;
X₁₂ is N;
X₁₃ is P, Q, or S;
X₁₄ is K, A, or N;
X₁₅ is F or L;
X₁₆ is D, K, or R; and
X₁₇ is G, D, or S;
CDR-H3. $X_1$-$X_2$-$X_3$-$X_4$-$X_5$-$X_6$-$X_7$-$X_8$-$X_9$-$X_{10}$-$X_{11}$-$X_{12}$ (SEQ ID NO:921), wherein;
X₁ is Y, F, or D;
X₂ is Y, L, S, or G;
X₃ is K, T, R, or Y;
X₄ is Y or W;
X₅ is E, D, or I;
X₆ is S, G, or Y;
X₇ is F, Y, or T;
X₈ is Y, F, or M;
X₉ is G, T, or is not present;
X₁₀ is M or is not present;
X₁₁ is D; and
X₁₂ is Y;
CDR-L1. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$ (SEQ ID NO:922), wherein;
X₁ is S, K, or R;
X₂ is A or S;
X₃ is S;
X₄ is S or Q;
X₅ is S or is not present;
X₆ is L or is not present;
X₇ is V or is not present;
X₈ is H or is not present;
X₉ is S or is not present;
X₁₀ is S, N, or is not present;
X₁₁ is S, V, or G;
X₁₂ is I, N, or S;
X₁₃ is S, N, T, or I;
X₁₄ is Y or D;
X₁₅ is M, V, L, or I; and
X₁₆ is C, A, H, Y, or G;
CDR-L2. $X_1$-$X_2$-$X_3$-$X_4$-$X_5$-$X_6$-$X_7$ (SEQ ID NO:923), wherein;
X₁ is D, Y, K, A, or H;
X₂ is T, A, or V;
X₃ is S or F;
X₄ is K, N, or E;
X₅ is L or R;
X₆ is A, Y, or F; and
X₇ is S or T;
and
CDR-L3. $X_1$-$X_2$-$X_3$-$X_4$-$X_5$-$X_6$-$X_7$-$X_8$-$X_9$ (SEQ ID NO:924), wherein;
X₁ is Q, S, or H;
X₂ is Q;
X₃ is R, D, S, or G;
X₄ is S, Y, or T;
X₅ is S, G, or H;
X₆ is Y, S, V, or A;
X₇ is P or is not present;
X₈ is W, Y, or L; and
X₉ is T.

In an embodiment, a binding protein according to the invention comprises at least one CDR comprising an amino acid sequence selected from the group consisting of:
residues 31-35 of SEQ ID NO:26; residues 50-66 of SEQ ID NO:26; residues 99-110 of SEQ ID NO:26;
residues 24-33 of SEQ ID NO:27; residues 49-55 of SEQ ID NO:27; residues 88-96 of SEQ ID NO:27;
residues 31-35 of SEQ ID NO:28; residues 50-66 of SEQ ID NO:28; residues 99-108 of SEQ ID NO:28;
residues 24-34 of SEQ ID NO:29; residues 50-56 of SEQ ID NO:29; residues 89-97 of SEQ ID NO:29;
residues 31-35 of SEQ ID NO:30; residues 50-66 of SEQ ID NO:30; residues 99-108 of SEQ ID NO:30;
residues 24-34 of SEQ ID NO:31; residues 50-56 of SEQ ID NO:31; residues 89-97 of SEQ ID NO:31;
residues 31-35 of SEQ ID NO:32; residues 50-65 of SEQ ID NO:32; residues 98-109 of SEQ ID NO:32;
residues 24-39 of SEQ ID NO:33; residues 55-61 of SEQ ID NO:33; residues 94-101 of SEQ ID NO:33;
residues 31-35 of SEQ ID NO:34; Residues 50-66 of SEQ ID NO:34; residues 99-110 of SEQ ID NO:34;
residues 24-33 of SEQ ID NO:35; residues 49-55 of SEQ ID NO:35; residues 88-96 of SEQ ID NO:35;
residues 31-35 of SEQ ID NO:36; residues 50-66 of SEQ ID NO:36; residues 99-108 of SEQ ID NO:36;
residues 24-34 of SEQ ID NO:37; residues 50-56 of SEQ ID NO:37; residues 89-97 of SEQ ID NO:37;
residues 31-35 of SEQ ID NO:38; residues 50-65 of SEQ ID NO:38; residues 98-107 of SEQ ID NO:38;
residues 24-39 of SEQ ID NO:39; residues 55-61 of SEQ ID NO:39; and residues 94-102 of SEQ ID NO:39.

In another embodiment, an IL-17 binding protein of the invention comprises at least 3 CDRs described above.

In another embodiment, an IL-17 binding protein comprises at least 3 CDRs selected from a variable domain CDR set consisting of:

| VH 7D7 CDR Set | |
|---|---|
| VH 7D7 CDR-H1 | Residues 31-35 of SEQ ID NO: 26 |
| VH 7D7 CDR-H2 | Residues 50-66 of SEQ ID NO: 26 |
| VH 7D7 CDR-H3 | Residues 99-110 of SEQ ID NO: 26 |
| VL 7D7 CDR Set | |
| VL 7D7 CDR-L1 | Residues 24-33 of SEQ ID NO: 27 |
| VL 7D7 CDR-L2 | Residues 49-55 of SEQ ID NO: 27 |
| VL 7D7 CDR-L3 | Residues 88-96 of SEQ ID NO: 27 |
| VH 6C6 CDR Set | |
| VH 6C6 CDR-H1 | Residues 31-35 of SEQ ID NO: 28 |
| VH 6C6 CDR-H2 | Residues 50-66 of SEQ ID NO: 28 |
| VH 6C6 CDR-H3 | Residues 99-108 of SEQ ID NO: 28 |
| VL 6C6 CDR Set | |
| VL 6C6 CDR-L1 | Residues 24-34 of SEQ ID NO: 29 |
| VL 6C6 CDR-L2 | Residues 50-56 of SEQ ID NO: 29 |
| VL 6C6 CDR-L3 | Residues 89-97 of SEQ ID NO.: 29 |
| VH 1D8 CDR Set | |
| VH 1D8 CDR-H1 | Residues 31-35 of SEQ ID NO: 30 |
| VH 1D8 CDR-H2 | Residues 50-66 of SEQ ID NO: 30 |
| VH 1D8 CDR-H3 | Residues 99-108 of SEQ ID NO: 30 |

-continued

| VL 1D8 CDR Set | |
|---|---|
| VL 1D8 CDR-L1 | Residues 24-34 of SEQ ID NO: 31 |
| VL 1D8 CDR-L2 | Residues 50-56 of SEQ ID NO: 31 |
| VL 1D8 CDR-L3 | Residues 89-97 of SEQ ID NO: 31 |
| VH 8B12 CDR Set | |
| VH 8B12 CDR-H1 | Residues 31-35 of SEQ ID NO: 32 |
| VH 8B12 CDR-H2 | Residues 50-65 of SEQ ID NO: 32 |
| VH 8B12 CDR-H3 | Residues 98-109 of SEQ ID NO: 32 |
| VL 8B12 CDR Set | |
| VL 8B12 CDR-L1 | Residues 24-39 of SEQ ID NO: 33 |
| VL 8B12 CDR-L2 | Residues 55-61 of SEQ ID NO: 33 |
| VL 8B12 CDR-L3 | Residues 94-101 of SEQ ID NO: 33 |
| VR 10F7 CDR Set | |
| VH 10F7 CDR-H1 | Residues 31-35 of SEQ ID NO: 34 |
| VH 10F7 CDR-H2 | Residues 50-66 of SEQ ID NO: 34 |
| VH 10F7 CDR-H3 | Residues 99-110 of SEQ ID NO: 34 |
| VL 10F7 CDR Set | |
| VL 10F7 CDR-L1 | Residues 24-33 of SEQ ID NO: 35 |
| VL 10F7 CDR-L2 | Residues 49-55 of SEQ ID NO: 35 |
| VL 10F7 CDR-L3 | Residues 88-96 of SEQ ID NO: 35 |
| VH 5C5 CDR Set | |
| VH 5C5 CDR-H1 | Residues 31-35 of SEQ ID NO: 36 |
| VH 5C5 CDR-H2 | Residues 50-66 of SEQ ID NO: 36 |
| VH 5C5 CDR-H3 | Residues 99-108 of SEQ ID NO: 36 |
| VL 5C5 CDR Set | |
| VL 5C5 CDR-L1 | Residues 24-34 of SEQ ID NO: 37 |
| VL 5C5 CDR-L2 | Residues 50-56 of SEQ ID NO: 37 |
| VL 5C5 CDR-L3 | Residues 89-97 of SEQ ID NO: 37 |
| VH 10G9 CDR Set | |
| VH 10G9 CDR-H1 | Residues 31-35 of SEQ ID NO: 38 |
| VH 10G9 CDR-H2 | Residues 50-65 of SEQ ID NO: 38 |
| VH 10G9 CDR-H3 | Residues 98-107 of SEQ ID NO: 38 |
| VL 10G9 CDR Set | |
| VL 10G9 CDR-L1 | Residues 24-39 of SEQ ID NO: 39 |
| VL 10G9 CDR-L2 | Residues 55-61 of SEQ ID NO: 39 |
| VL 10G9 CDR-L3 | Residues 94-102 of SEQ ID NO: 39 |

In another embodiment, an IL-17 binding protein may comprise at least two variable domain CDR sets described above. Preferably, the two variable domain CDR sets are selected from the group consisting of:
VH 7D7 CDR Set and VL 7D7 CDR Set;
VH 6C6 CDR Set and VL 6C6 CDR Set;
VH 1D8 CDR Set and VL 1D8 CDR Set;
VH 8B12 CDR Set and VL 8B12 CDR Set;
VH 10F7 CDR Set and VL 10F7 CDR Set; and
VH 5C5 CDR Set and VL 5C5 CDR Set; and
VH 10G9 CDR Set and VL 10G9 Set.

In other embodiment, a binding protein comprise one or more CDRs described above further comprises a human acceptor framework. Preferably, the human framework comprises an amino acid sequence selected group consisting:
SEQ ID NO.:7
SEQ ID NO.:8
SEQ ID NO.:9
SEQ ID NO.:10
SEQ ID NO.:11
SEQ ID NO.:12
SEQ ID NO.:13
SEQ ID NO.:14
SEQ ID NO.:15
SEQ ID NO.:16
SEQ ID NO.:17
SEQ ID NO.:18
SEQ ID NO.:19
SEQ ID NO.:20
SEQ ID NO.:21
SEQ ID NO.:22
SEQ ID NO.:23
SEQ ID NO.:24 AND
SEQ ID NO.:25.

An IL-17 binding protein may comprise a human acceptor framework comprising at least one Framework Region amino acid substitution, wherein the amino acid sequence of the framework is at least 65% identical to the sequence of said human acceptor framework and comprises at least 70 amino acid residues identical to said human acceptor framework.

In another embodiment, an IL-17 binding protein comprises a human acceptor framework, wherein said acceptor framework comprises at least one framework region amino acid substitution at a key residue, said key residue selected from the group consisting of:
a residue adjacent to a CDR;
a glycosylation site residue;
a rare residue;
a residue capable of interacting with human IL-13;
a residue capable of interacting with a CDR;
a canonical residue;
a contact residue between heavy chain variable region and light chain variable region;
a residue within a Vernier zone; and
a residue in a region that overlaps between a Chothia-defined variable heavy chain CDR1 and a Kabat-defined first heavy chain framework.

In a preferred embodiment, an IL-17A binding protein may comprise a key residue, wherein said key residue is selected from the group consisting of: 2H, 4H, 24H, 26H, 27H, 29H, 34H, 35H, 37H, 39H, 44H, 45H, 47H, 48H, 49H, 50H, 51H, 58H, 59H, 60H, 63H, 67H, 69H, 71H, 73H, 76H, 78H, 91H, 93H, 94H, 2L, 4L, 25L, 29L, 27bL, 33L, 34L, 36L, 38L, 43L, 44L, 46L, 47L, 48L, 49L, 55L, 58L, 62L, 64L, 71L, 87L, 89L, 90L, 91L, 94L, 95L (all Kabat numbering). A preferred subset of these residues for the humanization of IL-17 antibodies consists of 27H, 48H, 67H, 69H, 93H, 36L, 43L, 46L, 47L, 49L, 58L, 71L, and 87L.

In yet another embodiment, an IL-17 binding protein according to the invention comprises a consensus human variable domain that is a consensus human variable domain described herein.

In a preferred embodiment, an IL-17 binding protein comprises at least one variable domain having an amino acid sequence selected from the group consisting of:
SEQ ID NO:60
SEQ ID NO:61
SEQ ID NO:62
SEQ ID NO:63
SEQ ID NO:64
SEQ ID NO:65
SEQ ID NO:66
SEQ ID NO:67
SEQ ID NO:68
SEQ ID NO:69
SEQ ID NO:70
SEQ ID NO:71
SEQ ID NO:72
SEQ ID NO:73
SEQ ID NO:74
SEQ ID NO:75
SEQ ID NO:76
SEQ ID NO:931
SEQ ID NO:932 AND
SEQ ID NO:933.

More preferably, an IL-17 binding protein described herein comprises two variable domains, wherein said two variable domains have amino acid sequences selected from the group consisting of:
SEQ ID NO:60 & SEQ ID NO:62,
SEQ ID NO:60 & SEQ ID NO:63,
SEQ ID NO:60 & SEQ ID NO:64,
SEQ ID NO:60 & SEQ ID NO:65,
SEQ ID NO:60 & SEQ ID NO:66
SEQ ID NO:60 & SEQ ID NO:67,
SEQ ID NO:60 & SEQ ID NO:68,
SEQ ID NO:61 & SEQ ID NO:62,
SEQ ID NO:61 & SEQ ID NO:63,
SEQ ID NO:61 & SEQ ID NO:64,
SEQ ID NO:61 & SEQ ID NO:65,
SEQ ID NO:61 & SEQ ID NO:66,
SEQ ID NO:61 & SEQ ID NO:67, AND
SEQ ID NO:61 & SEQ ID NO:68.

In another embodiment, a binding protein described herein comprises at least one variable domain having an amino acid sequence selected from the group consisting of:
SEQ ID NO:60
SEQ ID NO:61
SEQ ID NO:62
SEQ ID NO:63
SEQ ID NO:64
SEQ ID NO:65
SEQ ID NO:66
SEQ ID NO:67
SEQ ID NO:68
SEQ ID NO:69
SEQ ID NO:70
SEQ ID NO:71
SEQ ID NO:72
SEQ ID NO:73
SEQ ID NO:74
SEQ ID NO:75
SEQ ID NO:76
SEQ ID NO:931
SEQ ID NO:932 AND
SEQ ID NO:933.

In another embodiment, a binding protein of the invention comprises an antigen binding domain capable of binding human IL-17, said antigen binding domain comprising at least one CDR comprising an amino acid sequence selected from the group consisting of:

CDR-H1. $X_1-X_2-X_3-X_4-X_5$ (SEQ ID NO:925), wherein;
$X_1$ is N, A, D, or S;
$X_2$ is Y, F, or L;
$X_3$ is G, D, or A;
$X_4$ is M or I; and
$X_5$ is H, D, or S;

CDR-H2. $X_1-X_2-X_3-X_4-X_5-X_6-X_7-X_8-X_9-X_{10}-X_{11}-X_{12}-X_{13}-X_{14}-X_{15}-X_{16}-X_{17}$ (SEQ ID NO:926), wherein;
$X_1$ is V, W, or G;
$X_2$ is I, T, M, or F;
$X_3$ is S, N, T, or D;
$X_4$ is Y or P;
$X_5$ is D, N, or I;
$X_6$ is G, S, L, or E;
$X_7$ is S or G;
$X_8$ is N, T, or E;
$X_9$ is K, T, or A;
$X_{10}$ is Y, G, N, or V;
$X_{11}$ is Y or V;
$X_{12}$ is A;
$X_{13}$ is D, P, or Q;
$X_{14}$ is S, K, or N;
$X_{15}$ is V or F;
$X_{16}$ is K, R, or Q; and
$X_{17}$ is G;

CDR-H3. $X_1-X_2-X_3-X_4-X_5-X_6-X_7-X_8-X_9-X_{10}-X_{11}-X_{12}-X_{13}-X_{14}-X_{15}-X_{16}-X_{17}$ (SEQ ID NO:927), wherein;
$X_1$ is V, S, E, or I;
$X_2$ is G, S, P, or R;
$X_3$ is A, E, N, or P;
$X_4$ is S, D, or W;
$X_5$ is G, E, F, or L;
$X_6$ is D, G, or W;
$X_7$ is Y, I, N, or G;
$X_8$ is Y, T, G, or A;
$X_9$ is Y or I;
$X_{10}$ is S, G, or Y;
$X_{11}$ is Y, F, or T;
$X_{12}$ is G, T, or is not present;
$X_{13}$ is L, H, or is not present;
$X_{14}$ is H or is not present;
$X_{15}$ is F or is not present;
$X_{16}$ is D; and
$X_{17}$ is V, N, or Y;

CDR-L1. $X_1-X_2-X_3-X_4-X_5-X_6-X_7-X_8-X_9-X_{10}-X_{11}-X_{12}-X_{13}$ (SEQ ID NO:928), wherein;
$X_1$ is S, R, or K;
$X_2$ is G or A;
$X_3$ is S or D;
$X_4$ is N, K, or Q;
$X_5$ is S or is not present;
$X_6$ is N or is not present;
$X_7$ is I, L, N, or D;
$X_8$ is G or I;
$X_9$ is S, N, G, or D;
$X_{10}$ is H, R, S, or D;
$X_{11}$ is S, Y, A, or D;
$X_{12}$ is V, A, L, or M; and
$X_{13}$ is N, C, or H;

CDR-L2. $X_1-X_2-X_3-X_4-X_5-X_6-X_7$ (SEQ ID NO:929), wherein;
$X_1$ is G, Q, Y, or E;
$X_2$ is I, D, or A;
$X_3$ is G, N, S, or T;
$X_4$ is Q, K, or T;
$X_5$ is R, S, or L;
$X_6$ is P, I, or V; and
$X_7$ is S or P;
and CDR-L3. $X_1-X_2-X_3-X_4-X_5-X_6-X_7-X_8-X_9-X_{10}-X_{11}$ (SEQ ID NO:930),
wherein;
$X_1$ is A, Q, H, or L;
$X_2$ is T or Q;
$X_3$ is W, S, or H;
$X_4$ is D or T;
$X_5$ is D or S;
$X_6$ is S, T, L, or F;
$X_7$ is L, T, or P;
$X_8$ is G, H, or Y;
$X_9$ is G, S, or T;
$X_{10}$ is Y or is not present; and
$X_{11}$ is V or is not present;
a CDR-H1 amino acid sequence, a CDR-H2 amino acid sequence, and a CDR-H3 amino acid sequence of any variable heavy region (VH) in Table 21, Table 23, Table 24, or Table 27; and a CDR-L1 amino acid sequence, a CDR-L2 amino acid sequence, and a CDR-L3 amino acid sequence of any variable light region (VL) in Table 21, Table 23, Table 25, or Table 27.

In a preferred embodiment, at least one CDR of the above-described IL-17 binding protein comprises an amino acid sequence selected from the group consisting of:

residues 31-35 of SEQ ID NO:40; residues 50-66 of SEQ ID NO.:40; residues 99-103 of SEQ ID NO.:40;
residues 23-35 of SEQ ID NO:41; residues 51-57 of SEQ ID NO.:41; residues 90-110 of SEQ ID NO.:41;
residues 31-35 of SEQ ID NO:42; residues 50-66 of SEQ ID NO.:42; residues 99-103 of SEQ ID NO.:42;
residues 23-35 of SEQ ID NO:43; residues 51-57 of SEQ ID NO.:43; residues 90-110 of SEQ ID NO.:43;
residues 31-35 of SEQ ID NO:44; residues 50-66 of SEQ ID NO.:44; residues 99-101 of SEQ ID NO.:44;
residues 23-35 of SEQ ID NO:45; residues 51-57 of SEQ ID NO.:45; residues 90-110 of SEQ ID NO.:45;
residues 31-35 of SEQ ID NO:46; residues 50-66 of SEQ ID NO.:46; residues 99-115 of SEQ ID NO.:46;
residues 24-34 of SEQ ID NO:47; residues 50-56 of SEQ ID NO.:47; residues 89-97 of SEQ ID NO.:47;
residues 31-35 of SEQ ID NO:48; residues 50-66 of SEQ ID NO.:48; residues 99-101 of SEQ ID NO.:48;
residues 24-34 of SEQ ID NO:49; residues 50-56 of SEQ ID NO.:49; and residues 89-97 of SEQ ID NO.:49;
an amino acid sequence for a CDR-H1, an amino acid sequence for a CDR-H2, and an amino acid sequence for a CDR-H3 of a VH in Table 21, Table 23, Table 24, or Table 27; and
an amino acid sequence for a CDR-L1, an amino acid sequence for a CDR-L2, and an amino acid sequence for a CDR-L3 of a VL in Table 21, Table 23, Table 25, or Table 27.

In another embodiment, the IL-17 binding protein of the invention comprises at least 3 CDRs described above.

In another embodiment, an IL-17 binding protein of the invention comprises an antigen binding domain that comprises a $V_H$. More preferably, the $V_H$ comprises an amino acid sequence selected from the group consisting of: SEQ ID NO:40, SEQ ID NO:42, SEQ ID NO:44, SEQ ID NO:46, SEQ ID NO:48, an amino acid sequence of a VH in Table 21, an amino acid sequence of a VH in Table 23, an amino acid sequence of a VH in Table 24, and an amino acid sequence of a VH in Table 27.

In another embodiment, the IL-17 binding protein of the invention comprises an antigen binding domain that comprises a $V_L$. Preferably, the $V_L$ comprises an amino acid sequence selected from the group consisting of SEQ ID NO:41, SEQ ID NO:43, SEQ ID NO:45, SEQ ID NO:47, SEQ ID NO:49, an amino acid sequence of a VL in Table 21, an amino acid sequence of a VL in Table 23, an amino acid sequence of a VL in Table 25, and an amino acid sequence of a VL in Table 27.

In a further embodiment, the IL-17 binding protein of the invention comprises an antigen binding domain comprising a $V_H$ and a $V_L$. In a preferred embodiment, the $V_H$ comprises an amino acid sequence selected from the group consisting of: SEQ ID NO:40, SEQ ID NO:42, SEQ ID NO:44, SEQ ID NO:46, SEQ ID NO:48, an amino acid sequence of a VH in Table 21, an amino acid sequence of a VH in Table 23, an amino acid sequence of a VH in Table 24, and an amino acid sequence of a VH in Table 27.

More preferably, the $V_L$ of an IL-17 binding protein of the invention comprises an amino acid sequence of a VL in Table 21, an amino acid sequence of a VL in Table 23, an amino acid sequence of a VL in Table 25, or an amino acid sequence of a VL in Table 27 and the $V_H$ comprises an amino acid sequence of a VH in Table 21, an amino acid sequence of a VH in Table 23, an amino acid sequence of a VH in Table 24, or an amino acid sequence of a VH in Table 27.

In another embodiment, an IL-17 binding protein described herein, further comprises a heavy chain immunoglobulin constant domain selected from the group consisting of: a human IgM constant domain; a human IgG1 constant domain; a human IgG2 constant domain; a human IgG3 constant domain; a human IgG4 constant domain; a human IgE constant domain and a human IgA constant domain. Preferably, the heavy chain immunoglobulin constant region is a human IgG1 constant domain. More preferably, the human IgG1 constant domain comprises amino acid sequence selected from the group consisting of SEQ ID NO:3 and SEQ ID NO:4.

In another embodiment, an IL-17 binding protein described herein comprises a light chain immunoglobulin constant domain is a human Ig kappa constant domain or a human Ig lambda constant domain. A preferred human Ig kappa constant domain comprises amino acid sequence SEQ ID NO:5. A preferred human Ig lambda constant domain comprises amino acid sequence SEQ ID NO:6.

In another embodiment, an IL-17 binding protein described herein is selected from the group consisting of: an immunoglobulin molecule; an scFv; a monoclonal antibody; a human antibody; a chimeric antibody; a humanized antibody; a single domain antibody; a Fab fragment; an Fab' fragment; an F(ab')2; an Fv; and a disulfide linked Fv. In a preferred embodiment, the IL-17 binding protein is a human antibody.

Another aspect of the invention is a binding protein capable of binding human IL-17, wherein the binding protein comprises:
an Ig constant heavy region having an amino acid sequence selected from the group consisting of SEQ ID NO:3 and SEQ ID NO: 4;
an Ig constant light region having an amino acid sequence selected from the group consisting of SEQ ID NO:5 and SEQ ID NO: 6;
an Ig variable heavy region having an amino acid sequence of a VH in Table 21, an amino acid sequence of a VH in Table 23, an amino acid sequence of a VH in Table 24, or an amino acid sequence of a VH in Table 27; and
an Ig variable light region having an amino acid sequence of a VL in Table 21, an amino acid sequence of a VL in Table 23, an amino acid sequence of a VL in Table 25, or an amino acid sequence of a VL in Table 27.

More preferably, a binding protein according to the invention is capable of binding human IL-17 and comprises:
an Ig constant heavy region having an amino acid sequence of SEQ ID NO:3;
an Ig constant light region having an amino acid sequence of SEQ ID NO:5;
an Ig variable heavy region having an amino acid sequence of a VH in Table 21, an amino acid sequence of a VH in Table 23, an amino acid sequence of a VH in Table 24, or an amino acid sequence of a VH in Table 27; and
an Ig variable light region having an amino acid sequence of a VL in Table 21, an amino acid sequence of a VL in Table 23, an amino acid sequence of a VL in Table 25, or an amino acid sequence of a VL in Table 27.

In another aspect, the invention provides a multivalent, multispecific DVD-Ig™ binding protein comprising a polypeptide chain, wherein said polypeptide chain comprises VD1-(X1)n-VD2-C-(X2)n, wherein;

VD1 is a first heavy chain variable domain;
VD2 is a second heavy chain variable domain;
C is a heavy chain constant domain;
X1 is a linker with the proviso that it is not CH1;
X2 is an Fc region; and
n is 0 or 1;
wherein the binding protein is capable of binding human IL-17 and TNF-α;
wherein VD1 comprises an amino acid sequence of a variable heavy region (VH) of an anti-TNF-α antibody wherein said amino acid sequence is any of SEQ ID NOs:563, 573, 578, 593, 628, 638, 648, 658, 668, 678, 688, 698, 708, 718, 728, 738, 748, 758, 763, 773, 783, 793, 803, 813, 823, 833, 843, 853, 863, 873, and 883; and
wherein VD2 comprises the amino acid sequence of a VH region of anti-IL-17 antibody wherein said amino acid sequence is any of SEQ ID NOs:565, 575, 580, 595, 630, 640, 650, 660, 670, 680, 690, 700, 710, 720, 730, 740, 750, 760, 765, 775, 795, 805, 815, 825, 835, 845, 855, 865, 875, and 885.

In an embodiment of the DVD-Ig binding protein described above, VD1 and VD2 comprise an amino acid sequence of any of SEQ ID NOs: 562, 572, 577, 592, 627, 637, 647, 657, 667, 677, 687, 697, 707, 717, 727, 737, 747, 757, 762, 772, 782, 792, 802, 812, 822, 832, 842, 852, 862, 872, and 882.

In another embodiment, the invention provides a multivalent, multispecific DVD-Ig binding protein comprising a polypeptide chain, wherein said polypeptide chain comprises VD1-(X1)n-VD2-C-(X2)n, wherein;
VD1 is a first light chain variable domain;
VD2 is a second light chain variable domain;
C is a light chain constant domain;
X1 is a linker with the proviso that it is not CH1;
X2 does not comprise an Fc region; and
n is 0 or 1;
wherein the binding protein is capable of binding human IL-17 and TNF-α;
wherein VD1 comprises an amino acid sequence of a variable light region (VL) of an anti-TNF-α antibody wherein said amino acid sequence is any of SEQ ID NOs:568, 583, 588, 598, 603, 608, 613, 618, 623, 633, 643, 653, 663, 673, 683, 693, 703, 713, 723, 733, 743, 753, 768, 778, 788, 798, 808, 818, 828, 848, 858, 868, and 878; and
wherein VD2 comprises an amino acid sequence of a VL region of anti-IL-17 antibody wherein said amino acid sequence is any of SEQ ID NOs:570, 585, 590, 600, 605, 610, 615, 620, 625, 635, 645, 655, 665, 675, 685, 695, 705, 715, 725, 735, 745, 755, 770, 780, 790, 800, 810, 820, 830, 850, 860, 870, and 880.

In an embodiment of the DVD-Ig binding protein described above the VD1 and VD2 light chain variable domains comprise an amino acid sequence of any of SEQ ID NOs:567, 582, 587, 597, 602, 607, 612, 617, 622, 632, 642, 652, 662, 672, 682, 692, 702, 712, 722, 732, 742, 752, 767, 777, 787, 797, 807, 817, 827, 847, 857, 867, and 877.

In a preferred embodiment of a multivalent, multispecific DVD-Ig binding protein described herein, n is 0.

In another embodiment, the invention provides a multivalent, multispecific DVD-Ig binding protein comprising first and second polypeptide chains, wherein said first polypeptide chain comprises a first VD1-(X1)n-VD2-C-(X2)n, wherein
VD1 is a first heavy chain variable domain;
VD2 is a second heavy chain variable domain;
C is a heavy chain constant domain;
X1 is a linker with the proviso that it is not CH1; and
X2 is an Fc region; and wherein said second polypeptide chain comprises a second VD1-(X1)n-VD2-C-(X2)n,
wherein
VD1 is a first light chain variable domain;
VD2 is a second light chain variable domain;
C is a light chain constant domain;
X1 is a linker with the proviso that it is not CH1;
X2 does not comprise an Fc region; and
n is 0 or 1;
wherein the binding protein is capable of binding human IL-17 and TNF-α;
wherein said VD1 and VD2 heavy chain variable domains comprise an amino acid sequence of any of SEQ ID NOs: 562, 572, 577, 592, 627, 637, 647, 657, 667, 677, 687, 697, 707, 717, 727, 737, 747, 757, 762, 772, 782, 792, 802, 812, 822, 832, 842, 852, 862, 872, and 882; and
wherein said VD1 and VD2 light chain variable domains comprise an amino acid sequence selected from the group consisting of SEQ ID NOs:567, 582, 587, 597, 602, 607, 612, 617, 622, 632, 642, 652, 662, 672, 682, 692, 702, 712, 722, 732, 742, 752, 767, 777, 787, 797, 807, 817, 827, 847, 857, 867, and 877.

In a preferred embodiment of a multivalent, multispecific DVD-Ig binding protein according to the invention, X1 or X2 is an amino acid sequence selected from the group consisting of SEQ ID NOs:888-918.

In another embodiment, a multivalent, multispecific DVD-Ig binding protein described herein comprises two first polypeptide chains and two second polypeptide chains.

In an embodiment of a multivalent, multispecific DVD-Ig binding protein described herein, the Fc region is selected from the group consisting of native sequence Fc region and a variant sequence Fc region. Preferably, the Fc region is selected from the group consisting of an Fc region from an IgG1, IgG2, IgG3, IgG4, IgA, IgM, IgE, and IgD.

In another embodiment of a multivalent, multispecific DVD-Ig binding protein described herein comprising a first and second polypeptide chains, VD1 of the first polypeptide chain and said VD1 of the second polypeptide chain are obtained from the same first and second parent antibody, respectively, or antigen binding portion thereof.

In an embodiment of a TNF-α and IL-17 binding DVD-Ig protein described herein, a parental anti-TNF-α antibody binds TNF-α with a potency different from the potency with which a parental anti-IL-17 antibody binds human IL-17.

In another embodiment of a TNF-α and IL-17 binding DVD-Ig protein described herein, a parental anti-TNF-α antibody binds TNF-α with an affinity different from the affinity with which said anti-IL-17 antibody binds human IL-17.

In another embodiment of a TNF-α and IL-17 binding DVD-Ig protein described herein an anti-TNF-α antibody and said anti-IL-17 antibody are selected from the group consisting of a human antibody, a CDR grafted antibody, and a humanized antibody.

In another embodiment, a TNF-α and IL-17 binding DVD-Ig protein described herein possesses at least one desired property exhibited by said anti-TNF-α antibody or said anti-IL-17 antibody. Preferably, the desired property is selected from one or more antibody parameters. More preferably, the antibody parameters are selected from the group consisting of antigen specificity, affinity to antigen, potency, biological function, epitope recognition, stability, solubility, production efficiency, immunogenicity, pharmacokinetics, bioavailability, tissue cross reactivity, and orthologous antigen binding.

In another embodiment, the invention provides a multivalent, multispecific DVD-Ig binding protein capable of binding two antigens comprising four polypeptide chains, wherein two polypeptide chains comprise VD1-(X1)n-VD2-C-(X2)n, wherein
  VD1 is a first heavy chain variable domain;
  VD2 is a second heavy chain variable domain;
  C is a heavy chain constant domain;
  X1 is a linker with the proviso that it is not CH1; and
  X2 is an Fc region; and
  wherein two polypeptide chains comprise VD1-(X1)n-VD2-C-(X2)n, wherein
  VD1 is a first light chain variable domain;
  VD2 is a second light chain variable domain;
  C is a light chain constant domain;
  X1 is a linker with the proviso that it is not CH1;
  X2 does not comprise an Fc region; and
  n is 0 or 1;
  wherein the VD1 and VD2 heavy chain variable domains comprise an amino acid sequence of any of SEQ ID NOs: 562, 572, 577, 592, 627, 637, 647, 657, 667, 677, 687, 697, 707, 717, 727, 737, 747, 757, 762, 772, 782, 792, 802, 812, 822, 832, 842, 852, 862, 872, and 882; and
  wherein the VD1 and VD2 light chain variable domains comprise an amino acid sequence selected from the group consisting of SEQ ID NOs:567, 582, 587, 597, 602, 607, 612, 617, 622, 632, 642, 652, 662, 672, 682, 692, 702, 712, 722, 732, 742, 752, 767, 777, 787, 797, 807, 817, 827, 847, 857, 867, and 877.

In another embodiment, the invention provides method of producing a multivalent, multispecific DVD-Ig binding protein described herein, comprising culturing a host cell carrying a vector comprising a nucleic acid described herein in culture medium under conditions sufficient to produce the binding protein. Preferably, 50%-75% of the binding protein produced according the method is a dual specific tetravalent DVD-Ig binding protein described herein. More preferably, 75%-90% of the binding protein produced according to this method is a dual specific tetravalent binding protein. Even more preferably, 90%-95% of the binding protein produced is a dual specific tetravalent binding protein.

Another embodiment of the invention is a protein produced according to the described method.

In another embodiment, the invention provides a pharmaceutical composition comprising a multivalent, multispecific DVD-Ig binding protein described herein and a pharmaceutically acceptable carrier.

In another embodiment, a pharmaceutical composition comprising a multivalent, multispecific DVD-Ig binding protein further comprises at least one additional agent. Preferably, the additional agent is selected from the group consisting of: therapeutic agent, imaging agent, cytotoxic agent, angiogenesis inhibitors; kinase inhibitors; co-stimulation molecule blockers; adhesion molecule blockers; anti-cytokine antibody or functional fragment thereof; methotrexate; cyclosporin; rapamycin; FK506; detectable label or reporter; a TNF antagonist; an antirheumatic; a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteroid, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, and a cytokine antagonist.

Another embodiment of the invention provides a method for treating a subject for a disease or a disorder by administering to the subject a multivalent, multispecific DVD-Ig binding protein described herein that binds TNF-α and IL-17 such that treatment is achieved.

The invention also provides a method for generating a multivalent, multispecific DVD-Ig binding protein described herein capable of binding TNF-α and human IL-17 comprising the steps of:
  a) obtaining a first parent antibody or antigen binding portion thereof, capable of binding TNF-α;
  b) obtaining a second parent antibody or antigen binding portion thereof, capable of binding human IL-17;
  c) constructing first and third polypeptide chains comprising VD1-(X1)n-VD2-C-(X2)n, wherein
    VD1 is a first heavy chain variable domain obtained from said first parent antibody or antigen binding portion thereof;
    VD2 is a second heavy chain variable domain obtained from said second parent antibody or antigen binding portion thereof;
    C is a heavy chain constant domain;
    X1 is a linker with the proviso that it is not CH1;
    X2 is an Fc region; and
    n is 0 or 1; and
  d) constructing second and fourth polypeptide chains comprising VD1-(X1)n-VD2-C-(X2)n, wherein
    VD1 is a first light chain variable domain obtained from said first parent antibody or antigen binding portion thereof;
    VD2 is a second light chain variable domain obtained from said second parent antibody or antigen binding thereof;
    C is a light chain constant domain;
    X1 is a linker with the proviso that it is not CH1;
    X2 does not comprise an Fc region; and
    n is 0 or 1; and
  e) expressing said first, second, third and fourth polypeptide chains;
such that a DVD-Ig binding protein capable of binding TNF-α and human IL-17 is generated, wherein the binding protein is capable of binding TNF-α and human IL-17;
  wherein VD1 and VD2 heavy chain variable domains comprise an amino acid sequence selected from the group consisting of SEQ ID NOs: of SEQ ID NOs: 562, 572, 577, 592, 627, 637, 647, 657, 667, 677, 687, 697, 707, 717, 727, 737, 747, 757, 762, 772, 782, 792, 802, 812, 822, 832, 842, 852, 862, 872, and 882; and
  wherein the VD1 and VD2 light chain variable domains comprise an amino acid sequence selected from the group consisting of SEQ ID NOs:567, 582, 587, 597, 602, 607, 612, 617, 622, 632, 642, 652, 662, 672, 682, 692, 702, 712, 722, 732, 742, 752, 767, 777, 787, 797, 807, 817, 827, 847, 857, 867, and 877.

In another embodiment of the method described above, said first parent antibody or antigen binding portion thereof, and said second parent antibody or antigen binding portion thereof, are selected from the group consisting of a human antibody, a CDR grafted antibody, and a humanized antibody.

In another embodiment of the method described above, said first parent antibody or antigen binding portion thereof, and said second parent antibody or antigen binding portion thereof, are selected from the group consisting of a Fab fragment, a F(ab')₂ fragment, a bivalent fragment comprising two Fab fragments linked by a disulfide bridge at the hinge region; a Fd fragment consisting of the VH and CH1 domains; a Fv fragment consisting of the VL and VH domains of a single arm of an antibody, a dAb fragment, an isolated complementarity determining region (CDR), a single chain antibody, and diabodies.

In another embodiment of the method, the first parent antibody or antigen binding portion thereof possesses at least one desired property exhibited by the DVD-Ig binding protein.

In another embodiment of the method described above the second parent antibody or antigen binding portion thereof possesses at least one desired property exhibited by the DVD-Ig binding protein.

Preferably, in the method described above, the Fc region is selected from the group consisting of a native sequence Fc region and a variant sequence Fc region. More preferably, the Fc region is selected from the group consisting of an Fc region from an IgG1, IgG2, IgG3, IgG4, IgA, IgM, IgE, and IgD.

In another embodiment, in a method described above, a desired property is selected from one or more antibody parameters of the first parent antibody or antigen binding portion thereof.

In another embodiment, in a method described above, a desired property is selected from one or more antibody parameters of the second parent antibody.

Preferably, said antibody parameters are selected from the group consisting of antigen specificity, affinity to antigen, potency, biological function, epitope recognition, stability, solubility, production efficiency, immunogenicity, pharmacokinetics, bioavailability, tissue cross reactivity, and orthologous antigen binding.

In another embodiment of the method described above, the first parent antibody or antigen binding portion thereof, binds said first antigen with a different affinity than the affinity with which said second parent antibody or antigen binding portion thereof, binds said second antigen.

In another embodiment, the first parent antibody or antigen binding portion thereof, binds said first antigen with a different potency than the potency with which said second parent antibody or antigen binding portion thereof, binds said second antigen.

In another embodiment, the invention provides a method for generating a DVD-Ig binding protein capable of binding TNF-α and human IL-17 with desired properties comprising the steps of a) obtaining a first parent antibody or antigen binding portion thereof, capable of binding TNF-α and possessing at least one desired property exhibited by the Dual Variable Domain Immunoglobulin;

b) obtaining a second parent antibody or antigen binding portion thereof, capable of binding human IL-17 and possessing at least one desired property exhibited by the Dual Variable Domain Immunoglobulin;

c) constructing first and third polypeptide chains comprising VD1-(X1)n-VD2-C-(X2)n, wherein;

VD1 is a first heavy chain variable domain obtained from said first parent antibody or antigen binding portion thereof;

VD2 is a second heavy chain variable domain obtained from said second parent antibody or antigen binding portion thereof;

C is a heavy chain constant domain;

X1 is a linker with the proviso that it is not CH1;

X2 is an Fc region; and n is 0 or 1;

d) constructing second and fourth polypeptide chains comprising VD1-(X1)n-VD2-C-(X2)n, wherein;

VD1 is a first light chain variable domain obtained from said first parent antibody or antigen binding portion thereof;

VD2 is a second light chain variable domain obtained from said second parent antibody or antigen binding portion thereof;

C is a light chain constant domain;

X1 is a linker with the proviso that it is not CH1;

X2 does not comprise an Fc region; and n is 0 or 1;

e) expressing said first, second, third, and fourth polypeptide chains; such that a DVD-Ig binding capable of binding said TNF-α and human IL-17 with desired properties is generated, wherein VD1 and VD2 heavy chain variable domains comprise an amino acid sequence selected from the group consisting of SEQ ID NOs: of SEQ ID NOs: 562, 572, 577, 592, 627, 637, 647, 657, 667, 677, 687, 697, 707, 717, 727, 737, 747, 757, 762, 772, 782, 792, 802, 812, 822, 832, 842, 852, 862, 872, and 882; and wherein the VD1 and VD2 light chain variable domains comprise an amino acid sequence selected from the group consisting of SEQ ID NOs:567, 582, 587, 597, 602, 607, 612, 617, 622, 632, 642, 652, 662, 672, 682, 692, 702, 712, 722, 732, 742, 752, 767, 777, 787, 797, 807, 817, 827, 847, 857, 867, and 877.

In another embodiment, an IL-17 binding protein described herein binds human IL-17 and is capable of modulating a biological function of IL-17.

The invention also provides a neutralizing binding protein, wherein the neutralizing binding protein comprises an IL-17 binding protein as described above, and wherein said neutralizing binding protein is capable of neutralizing IL-17.

In another embodiment, a neutralizing IL-17 binding protein according to the invention binds a human IL-17 is selected from the group consisting of pro-human IL-17; mature-human IL-17, and truncated-human IL-17.

Preferably a neutralizing IL-17 binding protein described herein diminishes the ability of IL-17 to bind to its receptor. Even more preferably, a neutralizing IL-17 binding protein diminishes the ability of pro-human IL-17, mature human IL-17, or a truncated human IL-17 to bind to the IL-17 receptor.

In another embodiment, a neutralizing IL-17 binding protein described herein is capable of reducing one or more of IL-17 biological activities selected from the group consisting of: Th1 modulation; Th2 modulation; Nk modulation; neutrophil modulation; monocyte-macrophage lineage modulation; neutrophil modulation; eosinophil modulation; B-cells modulation; cytokine modulation; chemokine modulation; adhesion molecule modulation; and cell recruitment modulation.

Preferably, an IL-17 binding protein of the invention has an on rate constant ($K_{on}$) to said target selected from the group consisting of: at least about $10^2 M^{-1} s^{-1}$; at least about $10^3 M^{-1} s^{-1}$; at least about $10^4 M^{-1} s^{-1}$; at least about $10^5 M^{-1} s^{-1}$; and at least about $10^6 M^{-1} s^{-1}$; as measured by surface plasmon resonance.

In another embodiment, an IL-17 binding protein has an off rate constant ($K_{off}$) to said target selected from the group consisting of: at most about $10^{-3} s^{-1}$; at most about $10^{-4} s^{-1}$; at most about $10^{-5} s^{-1}$; and at most about $10^{-6} s^{-1}$, as measured by surface plasmon resonance.

In another embodiment, an IL-17 binding protein of the invention has a dissociation constant ($K_D$) to said target selected from the group consisting of: at most about $10^{-7}$ M; at most about $10^{-8}$ M; at most about $10^{-9}$ M; at most about $10^{-10}$ M; at most about $10^{-11}$ M; at most about $10^{12}$ M; and at most $10^{-13}$ M.

Another aspect of the invention provides an IL-17 binding protein construct that comprises an IL-17 binding protein described herein and further comprises a linker polypeptide or an immunoglobulin constant domain. Preferred IL-17 binding protein constructs of the invention comprise an IL-17 binding protein selected from the group consisting
an immunoglobulin molecule,
a monoclonal antibody,
a chimeric antibody,
a CDR-grafted antibody,
a humanized antibody,
a Fab,
a Fab',
a F(ab')2,
a Fv,
a disulfide linked Fv,
a scFv,
a single domain antibody,
a diabody,
a multispecific antibody,
a dual specific antibody,
a bispecific antibody, and
a DVD-Ig™.

In a preferred embodiment, an IL-17 binding protein construct of the invention comprises a heavy chain immunoglobulin constant domain selected from the group consisting of:
a human IgM constant domain,
a human IgG1 constant domain,
a human IgG2 constant domain,
a human IgG3 constant domain,
a human IgG4 constant domain,
a human IgE constant domain,
and
a human IgA constant domain.

In yet another embodiment, an IL-17 binding protein construct comprises an immunoglobulin constant domain having an amino acid sequence selected from the group consisting of:
SEQ ID NO:3
SEQ ID NO:4
SEQ ID NO:5
and
SEQ ID NO:6.

In another embodiment, an IL-17 binding protein construct described herein has a greater half life in vivo than the soluble counterpart of said IL-17 binding protein construct.

Another aspect of the invention provides an IL-17 binding protein conjugate comprising an IL-17 binding protein construct, wherein the IL-17 binding protein conjugate further comprises an agent selected from the group consisting of: an immunoadhesion molecule, an imaging agent, a therapeutic agent, and a cytotoxic agent.

Preferred imaging agents useful in making IL-17 binding protein conjugates and in other aspects of the invention include, but are not limited to, a radiolabel, an enzyme, a fluorescent label, a luminescent label, a bioluminescent label, a magnetic label, and biotin.

Preferred radiolabels useful in the invention include, but are not limited, to those selected from the group consisting of: $^{3}$H, $^{14}$C, $^{35}$S, $^{90}$Y, $^{99}$Tc, $^{111}$In, $^{125}$I, $^{131}$I, $^{177}$Lu, $^{166}$Ho, and $^{153}$Sm.

In another embodiment, an IL-17 binding protein conjugate of the invention comprises a therapeutic or cytotoxic agent selected from the group consisting of an anti-metabolite, an alkylating agent, an antibiotic, a growth factor, a cytokine, an anti-angiogenic agent, an anti-mitotic agent, an anthracycline, toxin, and an apoptotic agent.

In another embodiment, binding proteins described herein possesses a human glycosylation pattern.

In another embodiment, an IL-17 binding protein described herein, including IL-17 binding protein constructs and IL-17 binding protein conjugates, may be in the form of a crystallized binding protein. Preferred crystalline forms retain at least some and preferably essentially all of the biologically activity of the uncrystallized form of an IL-17 binding protein described herein. Such crystalline forms may also be used as a carrier-free pharmaceutical controlled release crystallized IL-17 binding proteins.

In another embodiment, the invention provides isolated nucleic acids encoding IL-17 binding proteins, including binding protein constructs, described herein. Such nucleic acids may be inserted into a vector for carrying out various genetic analyses and recombinant techniques for expressing, characterizing, or improving one or more properties of an IL-17 binding protein described herein. Preferred vectors for cloning nucleic acids encoding binding proteins described herein include, but are not limited, pcDNA, pTT, pTT3, pEF-BOS, pBV, pJV, and pBJ.

The invention also provides a host cell comprising a vector comprising a nucleic acid encoding a binding protein described herein. Host cells useful in the invention may be prokaryotic or eukaryotic. A preferred prokaryotic host cell is *Escherichia coli*. Eukaryotic cells useful as host cells in the invention include protist cell, animal cell, plant cell, and fungal cell.

A preferred fungal cell is a yeast cell, including *Saccharomyces cerevisiae*.

A preferred animal cell useful as a host cell according to the invention includes, but is not limited to, a mammalian cell, an avian cell, and an insect cell. Preferred mammalian cells include CHO and COS cells. An insect cell useful as a host cell according to the invention is an insect Sf9 cell.

A vector may comprise a nucleic acid encoding an IL-17 binding protein described herein in which the nucleic acid is operably linked to appropriate transcriptional and/or translational sequences that permit expression of the binding protein in a particular host cell carrying the vector.

In another aspect, the invention provides a method of producing an IL-17 binding protein comprising culturing a host cell comprising a vector encoding the IL-17 binding protein in culture medium under conditions sufficient to produce the binding protein capable of binding IL-17. The protein so produced can be isolated and used in various compositions and methods described herein.

Compositions of the invention include a composition for the release of a binding protein said composition comprising:
(a) a formulation, wherein said formulation comprises a crystallized binding protein, described herein, and an ingredient; and
(b) at least one polymeric carrier.

Preferred polymeric carriers useful in compositions of the invention include, without limitation, one or more of the group consisting of: poly(acrylic acid), poly(cyanoacrylates), poly(amino acids), poly(anhydrides), poly(depsipeptide), poly(esters), poly(lactic acid), poly(lactic-co-glycolic acid) or PLGA, poly(b-hydroxybutryate), poly(caprolactone), poly (dioxanone); poly(ethylene glycol), poly((hydroxypropyl) methacrylamide, poly[(organo) phosphazene], poly(ortho esters), poly(vinyl alcohol), poly(vinylpyrrolidone), maleic anhydride-alkyl vinyl ether copolymers, pluronic polyols, albumin, alginate, cellulose and cellulose derivatives, collagen, fibrin, gelatin, hyaluronic acid, oligosaccharides, glycaminoglycans, sulfated polysaccharides, blends and copolymers thereof.

In another aspect, an ingredient of a composition of the invention is selected from the group consisting of albumin, sucrose, trehalose, lactitol, gelatin, hydroxypropyl-β-cyclodextrin, methoxypolyethylene glycol and polyethylene glycol.

In yet another embodiment, the invention provides a method for treating a mammal comprising the step of administering to the mammal an effective amount of a composition described herein.

The invention also provides pharmaceutical compositions comprising an IL-17 binding protein described herein and a pharmaceutically acceptable carrier. A pharmaceutically acceptable carrier may also serve as an adjuvant to increase the absorption or dispersion of the IL-17 binding protein in a composition of the invention. A preferred adjuvant is hyaluronidase.

In another embodiment, a pharmaceutical composition further comprises at least one additional therapeutic agent for treating a disorder in which IL-17 activity is detrimental.

In another embodiment, the invention provides a method for reducing human IL-17 activity comprising contacting human IL-17 with an IL-17 binding protein described herein such that human IL-17 activity is reduced.

In another embodiment, a pharmaceutical composition comprising an IL-17 binding protein described herein comprises at least one additional agent. Preferably, the additional agent is selected from the group consisting of: therapeutic agent, imaging agent, cytotoxic agent, angiogenesis inhibitors; kinase inhibitors; co-stimulation molecule blockers; adhesion molecule blockers; anti-cytokine antibody or functional fragment thereof; methotrexate; cyclosporin; rapamycin; FK506; detectable label or reporter; a TNF antagonist; an antirheumatic; a muscle relaxant, a narcotic, a non-steroid anti-inflammatory drug (NSAID), an analgesic, an anesthetic, a sedative, a local anesthetic, a neuromuscular blocker, an antimicrobial, an antipsoriatic, a corticosteroid, an anabolic steroid, an erythropoietin, an immunization, an immunoglobulin, an immunosuppressive, a growth hormone, a hormone replacement drug, a radiopharmaceutical, an antidepressant, an antipsychotic, a stimulant, an asthma medication, a beta agonist, an inhaled steroid, an epinephrine or analog, a cytokine, and a cytokine antagonist.

Another embodiment of the invention provides a method for treating a subject for a disease or a disorder by administering to the subject a multivalent, multispecific DVD-Ig binding protein described herein that binds TNF-α and IL-17 such that treatment is achieved.

In another embodiment, a disorder that may treated by a method of the invention comprising administering to a subject an IL-17 binding protein described herein is selected from the group comprising rheumatoid arthritis, osteoarthritis, juvenile chronic arthritis, septic arthritis, Lyme arthritis, psoriatic arthritis, reactive arthritis, spondyloarthropathy, systemic lupus erythematosus, Crohn's disease, ulcerative colitis, inflammatory bowel disease, insulin dependent diabetes mellitus, thyroiditis, asthma, allergic diseases, psoriasis, dermatitis scleroderma, graft versus host disease, organ transplant rejection, acute or chronic immune disease associated with organ transplantation, sarcoidosis, atherosclerosis, disseminated intravascular coagulation, Kawasaki's disease, Grave's disease, nephrotic syndrome, chronic fatigue syndrome, Wegener's granulomatosis, Henoch-Schoenlein purpurea, microscopic vasculitis of the kidneys, chronic active hepatitis, uveitis, septic shock, toxic shock syndrome, sepsis syndrome, cachexia, infectious diseases, parasitic diseases, acquired immunodeficiency syndrome, acute transverse myelitis, Huntington's chorea, Parkinson's disease, Alzheimer's disease, stroke, primary biliary cirrhosis, hemolytic anemia, malignancies, heart failure, myocardial infarction, Addison's disease, sporadic, polyglandular deficiency type I and polyglandular deficiency type II, Schmidt's syndrome, adult (acute) respiratory distress syndrome, alopecia, alopecia areata, seronegative arthropathy, arthropathy, Reiter's disease, psoriatic arthropathy, ulcerative colitic arthropathy, enteropathic synovitis, chlamydia, *yersinia* and *salmonella* associated arthropathy, spondyloarthropathy, atheromatous disease/arteriosclerosis, atopic allergy, autoimmune bullous disease, pemphigus vulgaris, pemphigus foliaceus, pemphigoid, linear IgA disease, autoimmune haemolytic anaemia, Coombs positive haemolytic anaemia, acquired pernicious anaemia, juvenile pernicious anaemia, myalgic encephalitis/Royal Free Disease, chronic mucocutaneous candidiasis, giant cell arteritis, primary sclerosing hepatitis, cryptogenic autoimmune hepatitis, Acquired Immunodeficiency Disease Syndrome, Acquired Immunodeficiency Related Diseases, Hepatitis B, Hepatitis C, common varied immunodeficiency (common variable hypogammaglobulinaemia), dilated cardiomyopathy, female infertility, ovarian failure, premature ovarian failure, fibrotic lung disease, cryptogenic fibrosing alveolitis, post-inflammatory interstitial lung disease, interstitial pneumonitis, connective tissue disease associated interstitial lung disease, mixed connective tissue disease associated lung disease, systemic sclerosis associated interstitial lung disease, rheumatoid arthritis associated interstitial lung disease, systemic lupus erythematosus associated lung disease, dermatomyositis/polymyositis associated lung disease, Sjögren's disease associated lung disease, ankylosing spondylitis associated lung disease, vasculitic diffuse lung disease, haemosiderosis associated lung disease, drug-induced interstitial lung disease, fibrosis, radiation fibrosis, bronchiolitis obliterans, chronic eosinophilic pneumonia, lymphocytic infiltrative lung disease, postinfectious interstitial lung disease, gouty arthritis, autoimmune hepatitis, type-1 autoimmune hepatitis (classical autoimmune or lupoid hepatitis), type-2 autoimmune hepatitis (anti-LKM antibody hepatitis), autoimmune mediated hypoglycaemia, type B insulin resistance with acanthosis nigricans, hypoparathyroidism, acute immune disease associated with organ transplantation, chronic immune disease associated with organ transplantation, osteoarthrosis, primary sclerosing cholangitis, psoriasis type 1, psoriasis type 2, idiopathic leucopaenia, autoimmune neutropaenia, renal disease NOS, glomerulonephritides, microscopic vasculitis of the kidneys, Lyme disease, discoid lupus erythematosus, male infertility idiopathic or NOS, sperm autoimmunity, multiple sclerosis (all subtypes), sympathetic ophthalmia, pulmonary hypertension secondary to connective tissue disease, Goodpasture's syndrome, pulmonary manifestation of polyarteritis nodosa, acute rheumatic fever, rheumatoid spondylitis, Still's disease, systemic sclerosis, Sjörgren's syndrome, Takayasu's disease/arteritis, autoimmune thrombocytopaenia, idiopathic thrombocytopaenia, autoimmune thyroid disease, hyperthyroidism, goitrous autoimmune hypothyroidism (Hashimoto's disease), atrophic autoimmune hypothyroidism, primary myxoedema, phacogenic uveitis, primary vasculitis, vitiligo acute liver disease, chronic liver diseases, alcoholic cirrhosis, alcohol-induced liver injury, choleosatatis, idiosyncratic liver disease, Drug-Induced hepatitis, Non-alcoholic Steatohepatitis, allergy and asthma, group B streptococci (GBS) infection, mental disorders (e.g., depression and schizophrenia), Th2 Type and Th1 Type mediated diseases, acute and chronic pain (different forms of pain), and cancers such as lung, breast, stomach, bladder, colon, pancreas, ovarian, prostate and rectal cancer and hematopoietic malignancies (leukemia and lymphoma) Abetalipoproteinemia, Acrocyanosis, acute and chronic parasitic or infectious processes, acute leukemia, acute lymphoblastic leukemia (ALL), acute myeloid leukemia (AML), acute or chronic bacterial infection, acute pancreatitis, acute renal failure, adenocarcinomas, aerial ectopic beats, AIDS dementia complex, alcohol-induced hepatitis, allergic conjunctivitis, allergic contact dermatitis, allergic rhinitis, allograft rejection, alpha-1-antitrypsin deficiency, amyotrophic lateral sclerosis, anemia, angina pectoris, anterior horn cell degeneration, anti-CD3 therapy, antiphospholipid syndrome, anti-receptor hypersensitivity reactions, aortic and peripheral aneurysms, aortic dissection, arterial hypertension, arteriosclerosis, arteriovenous fistula, ataxia, atrial fibrillation (sustained or paroxysmal), atrial flutter, atrioventricular block, B cell lymphoma, bone graft rejection, bone marrow transplant (BMT) rejection, bundle branch block, Burkitt's lymphoma, Burns, cardiac arrhythmias, cardiac stun syndrome, cardiac tumors, cardiomyopathy, cardiopulmonary bypass inflammation response, cartilage transplant rejection, cerebellar cortical degenerations, cerebellar disorders, chaotic or multifocal atrial tachycardia, chemotherapy associated disorders, chronic myelocytic leukemia (CML), chronic alcoholism, chronic inflammatory pathologies, chronic lymphocytic leukemia (CLL), chronic obstructive pulmonary disease (COPD), chronic salicylate intoxication, colorectal carcinoma, congestive heart failure, conjunctivitis, contact dermatitis, cor pulmonale, coronary artery disease, Creutzfeldt-Jakob disease, culture negative sepsis, cystic fibrosis, cytokine therapy associated disorders, Dementia pugilistica, demyelinating diseases, dengue hemorrhagic fever, dermatitis, dermatologic conditions, diabetes, diabetes mellitus, diabetic arteriosclerotic disease, Diffuse Lewy body disease, dilated congestive cardiomyopathy, disorders of the basal ganglia, Down's Syndrome in middle age, drug-induced movement disorders induced by drugs which block CNS dopamine receptors, drug sensitivity, eczema, encephalomyelitis, endocarditis, endocrinopathy, epiglottitis, Epstein-Barr virus infection, erythromelalgia, extrapyramidal and cerebellar disorders, familial hematophagocytic lymphohistiocytosis, fetal thymus implant rejection, Friedreich's ataxia, functional peripheral arterial disorders, fungal sepsis, gas gangrene, gastric ulcer, glomerular nephritis, graft rejection of any organ or tissue, gram negative sepsis, gram positive sepsis, granulomas due to intracellular organisms, hairy cell leukemia, Hallervorden-Spatz disease, Hashimoto's thyroiditis, hay fever, heart transplant rejection, hemachromatosis, hemodialysis, hemolytic uremic syndrome/thrombolytic thrombocytopenic purpura, hemorrhage, hepatitis (A), His bundle arrhythmias, HIV infection/HIV neuropathy, Hodgkin's disease, hyperkinetic movement disorders, hypersensitivity reactions, hypersensitivity pneumonitis, hypertension, hypokinetic movement disorders, hypothalamic-pituitary-adrenal axis evaluation, idiopathic Addison's disease, idiopathic pulmonary fibrosis, antibody mediated cytotoxicity, Asthenia, infantile spinal muscular atrophy, inflammation of the aorta, influenza a, ionizing radiation exposure, iridocyclitis/uveitis/optic neuritis, ischemia-reperfusion injury, ischemic stroke, juvenile rheumatoid arthritis, juvenile spinal muscular atrophy, Kaposi's sarcoma, kidney transplant rejection, *legionella*, leishmaniasis, leprosy, lesions of the corticospinal system, lipedema, liver transplant rejection, lymphedema, malaria, malignant Lymphoma, malignant histiocytosis, malignant melanoma, meningitis, meningococcemia, metabolic/idiopathic, migraine headache, mitochondrial multi-system disorder, mixed connective tissue disease, monoclonal gammopathy, multiple myeloma, multiple systems degenerations (Mencel Dejerine-Thomas Shi-Drager and Machado-Joseph), myasthenia gravis, *mycobacterium* avium intracellulare, *mycobacterium* tuberculosis, myelodysplastic syndrome, myocardial infarction, myocardial ischemic disorders, nasopharyngeal carcinoma, neonatal chronic lung disease, nephritis, nephrosis, neurodegenerative diseases, neurogenic I muscular atrophies, neutropenic fever, non-Hodgkins lymphoma, occlusion of the abdominal aorta and its branches, occlusive arterial disorders, OKT3® therapy, orchitis/epidydimitis, orchitis/vasectomy reversal procedures, organomegaly, osteoporosis, pancreas transplant rejection, pancreatic carcinoma, paraneoplastic syndrome/hypercalcemia of malignancy, parathyroid transplant rejection, pelvic inflammatory disease, perennial rhinitis, pericardial disease, peripheral atherosclerotic disease, peripheral vascular disorders, peritonitis, pernicious anemia, *pneumocystis carinii* pneumonia, pneumonia, POEMS syndrome (polyneuropathy, organomegaly, endocrinopathy, monoclonal gammopathy, and skin changes syndrome), post perfusion syndrome, post pump syndrome, post-MI cardiotomy syndrome, preeclampsia, Progressive supranucleo Palsy, primary pulmonary hypertension, radiation therapy, Raynaud's phenomenon and disease, Raynaud's disease, Refsum's disease, regular narrow QRS tachycardia, renovascular hypertension, reperfusion injury, restrictive cardiomyopathy, sarcomas, scleroderma, senile chorea, Senile Dementia of Lewy body type, seronegative arthropathies, shock, sickle cell anemia, skin allograft rejection, skin changes syndrome, small bowel transplant rejection, solid tumors, specific arrhythmias, spinal ataxia, spinocerebellar degenerations, streptococcal myositis, structural lesions of the cerebellum, Subacute sclerosing panencephalitis, Syncope, syphilis of the cardiovascular system, systemic anaphylaxis, systemic inflammatory response syndrome, systemic onset juvenile rheumatoid arthritis, T-cell or FAB ALL, Telangiectasia, thromboangitis obliterans, thrombocytopenia, toxicity, transplants, trauma/hemorrhage, type III hypersensitivity reactions, type IV hypersensitivity, unstable angina, uremia, urosepsis, urticaria, valvular heart diseases, varicose veins, vasculitis, venous diseases, venous thrombosis, ventricular fibrillation, viral and fungal infections, viral encephalitis/aseptic meningitis, viral-associated hemaphagocytic syndrome, Wernicke-Korsakoff syndrome, Wilson's disease, xenograft rejection of any organ or tissue, acute coronary syndromes, acute idiopathic polyneuritis, acute inflammatory demyelinating polyradiculoneuropathy, acute ischemia, adult Still's disease, alopecia areata, anaphylaxis, anti-phospholipid antibody syndrome, aplastic anemia, arteriosclerosis, atopic eczema, atopic dermatitis, autoimmune dermatitis, autoimmune disorder associated with *streptococcus* infection, autoimmune enteropathy, autoimmune hearing loss, autoimmune lymphoproliferative syndrome (ALPS), autoimmune myocarditis, autoimmune premature ovarian failure, blepharitis, bronchiectasis, bullous pemphigoid, cardiovascular disease, catastrophic antiphospholipid syndrome, celiac disease, cervical spondylosis, chronic ischemia, cicatricial pemphigoid, clinically isolated syndrome (cis) with risk for multiple sclerosis, conjunctivitis, childhood onset psychiatric disorder, chronic obstructive pulmonary disease (COPD), dacryocystitis, dermatomyositis, diabetic retinopathy, diabetes mellitus, disk herniation, disk prolapse, drug induced immune hemolytic anemia, endocarditis, endometriosis, endophthalmitis, episcleritis, erythema multiforme, erythema multiforme major, gestational pemphigoid, Guillain-Barré syndrome (GBS), hay fever, Hughes syndrome, idiopathic Parkinson's disease, idiopathic interstitial pneumonia, IgE-mediated allergy, immune hemolytic anemia, inclusion body myositis, infectious ocular inflammatory disease, inflammatory demyelinating disease, inflammatory heart disease, inflammatory kidney disease, IPF/UIP, iritis, keratitis, keratojunctivitis sicca, Kussmaul disease or Kussmaul-Meier disease, Landry's paralysis, Langerhan's cell histiocytosis, livedo reticularis, macular degeneration, microscopic polyangiitis, morbus bechterev, motor neuron disorders, mucous membrane pemphigoid, multiple organ failure, myasthenia gravis, myelodysplastic syndrome, myocarditis, nerve root disorders, neuropathy, non-A non-B hepatitis, optic neuritis, osteolysis, ovarian cancer, pauciarticular JRA, peripheral artery occlusive disease (PAOD), peripheral vascular disease (PVD), peripheral artery, disease (PAD), phlebitis, polyarteritis nodosa (or periarteritis nodosa), polychondritis, polymyalgia rheumatica, poliosis, polyarticular JRA, polyendocrine deficiency syndrome, polymyositis, polymyalgia rheumatica (PMR), post-pump syndrome, primary Parkinsonism, prostate and rectal cancer and hematopoietic malignancies (leukemia and lymphoma), prostatitis, pure red cell aplasia, primary adrenal insufficiency, recurrent neuromyelitis optica, restenosis, rheumatic heart disease, sapho (synovitis, acne, pustulosis, hyperostosis, and osteitis), scleroderma, secondary amyloidosis, shock lung, scleritis, sciatica, secondary adrenal insufficiency, silicone associated connective tissue disease, sneddon-wilkinson dermatosis, spondylitis ankylosans, Stevens-Johnson syndrome (SJS), systemic inflammatory response syndrome, temporal arteritis, toxoplasmic retinitis, toxic epidermal necrolysis, transverse myelitis, TRAPS (tumor necrosis factor receptor, type 1 allergic reaction, type II diabetes, urticaria, usual interstitial pneumonia (UIP), vasculitis, vernal conjunctivitis, viral retinitis, Vogt-Koyanagi-Harada syndrome (VKH syndrome), wet macular degeneration, wound healing, *yersinia* and *salmonella* associated arthropathy.

Another embodiment of the invention provides a method for treating a subject for a disease or a disorder in which IL-17 activity is detrimental by administering to the subject an IL-17 binding protein described herein such that treatment is achieved. The method can be used to a treat a disorder selected from the group consisting of respiratory disorders; asthma; allergic and nonallergic asthma; asthma due to infection; asthma due to infection with respiratory syncytial virus (RSV); chronic obstructive pulmonary disease (COPD); other conditions involving airway inflammation; eosinophilia; fibrosis and excess mucus production; cystic fibrosis; pulmonary fibrosis; atopic disorders; atopic dermatitis; urticaria; eczema; allergic rhinitis; and allergic enterogastritis; inflammatory and/or autoimmune conditions of the skin; inflammatory and/or autoimmune conditions of gastrointestinal organs; inflammatory bowel diseases (IBD); ulcerative colitis; Crohn's disease; inflammatory and/or autoimmune conditions of the liver; liver cirrhosis; liver fibrosis; liver fibrosis caused by hepatitis B and/or C virus; scleroderma; tumors or cancers; hepatocellular carcinoma; glioblastoma; lymphoma; Hodgkin's lymphoma; viral infections; HTLV-1 infection (e.g., from HTLV-1); suppression of expression of protective type 1 immune responses, and suppression of expression of protective type 1 immune responses during vaccination.

In a further embodiment of the above method, the administering to the subject is by at least one mode selected from parenteral, subcutaneous, intramuscular, intravenous, intraarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravesical, bolus, vaginal, rectal, buccal, sublingual, intranasal, and transdermal.

Another aspect of the invention is a method of treating a patient suffering from a disorder in which IL-17 is detrimental comprising the step of administering an IL-17A binding protein described herein before, concurrent, or after the administration of a second agent, wherein the second agent is selected from the group consisting of inhaled steroids; beta-agonists; short-acting or long-acting beta-agonists; antagonists of leukotrienes or leukotriene receptors; ADVAIR; IgE inhibitors; anti-IgE antibodies; XOLAIR; phosphodiesterase inhibitors; PDE4 inhibitors; xanthines; anticholinergic drugs; mast cell-stabilizing agents; Cromolyn; IL-4 inhibitors; IL-5 inhibitors; eotaxin/CCR3 inhibitors; antagonists of histamine or its receptors including H1, H2, H3, and H4; antagonists of prostaglandin D or its receptors DP1 and CRTH2; TNF antagonists; a soluble fragment of a TNF receptor; ENBREL®; TNF enzyme antagonists; TNF converting enzyme (TACE) inhibitors; muscarinic receptor antagonists; TGF-beta antagonists; interferon gamma; perfenidone; chemotherapeutic agents, methotrexate; leflunomide; sirolimus (rapamycin) or an analog thereof, CCI-779; COX2 or cPLA2 inhibitors; NSAIDs; immunomodulators; p38 inhibitors; TPL-2, MK-2 and NFkB inhibitors; budenoside; epidermal growth factor; corticosteroids; cyclosporine; sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β antibodies; anti-IL-6 antibodies; growth factors; elastase inhibitors; pyridinyl-imidazole compounds; antibodies or agonists of TNF, LT, IL-1, IL-2, IL-3, IL-4, IL-5, IL-6, IL-7, IL-8, IL-9, IL-10, IL-11, IL-12, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, EMAP-II, GM-CSF, FGF, or PDGF; antibodies of CD2, CD3, CD4, CD8, CD25, CD28, CD30, CD40, CD45, CD69, CD90 or their ligands; FK506; rapamycin; mycophenolate mofetil; ibuprofen; prednisolone; phosphodiesterase inhibitors; adenosine agonists; antithrombotic agents; complement inhibitors; adrenergic agents; IRAK, NIK, IKK, p38, or MAP kinase inhibitors; IL-1β converting enzyme inhibitors; TNF-α converting enzyme inhibitors; T-cell signaling inhibitors; metalloproteinase inhibitors; 6-mercaptopurines; angiotensin converting enzyme inhibitors; soluble cytokine receptors; soluble p55 TNF receptor; soluble p75 TNF receptor; sIL-1RI; sIL-1RII; sIL-6R; anti-inflammatory cytokines; IL-4; IL-10; IL-11; and TGF-β.

DETAILED DESCRIPTION OF THE INVENTION

This invention pertains to IL-17 binding proteins, including, but not limited to, anti-IL-17 antibodies, or antigen-binding portions thereof, that bind IL-17 and multivalent, multispecific binding proteins such as DVD-Ig™ that bind IL-17 and another target. Various aspects of the invention relate to antibodies and antibody fragments, DVD-Ig binding proteins, and pharmaceutical compositions thereof, as well as nucleic acids, recombinant expression vectors and host cells for making such IL-17 binding proteins, including antibodies, DVD-Ig binding proteins, and fragments thereof. Methods of using the IL-17 binding proteins of the invention to detect human IL-17A homodimer and/or IL-17A/F heterodimer; to inhibit human IL-17A homodimer and/or IL-17A/F heterodimer, either in vitro or in vivo; and to regulate gene expression are also encompassed by the invention.

The invention also encompasses any binding protein or antibody capable of competing with an IL-17 binding protein described herein.

Unless otherwise defined herein, scientific and technical terms used in connection with the present invention shall have the meanings that are commonly understood by those of ordinary skill in the art. The meaning and scope of the terms should be clear, however, in the event of any latent ambiguity, definitions provided herein take precedent over any dictionary or extrinsic definition. Further, unless otherwise required by context, singular terms shall include pluralities and plural terms shall include the singular. In this application, the use of "or" means "and/or" unless stated otherwise. Furthermore, the use of the term "including", as well as other forms, such as "includes" and "included", is not limiting. Also, terms such as "element" or "component" encompass both elements and components comprising one unit and elements and components that comprise more than one subunit unless specifically stated otherwise.

Generally, nomenclatures used in connection with, and techniques of, cell and tissue culture, molecular biology, immunology, microbiology, genetics and protein and nucleic acid chemistry and hybridization described herein are those well known and commonly used in the art. The methods and techniques of the present invention are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclatures used in connection with, and the laboratory procedures and techniques of, analytical chemistry, synthetic organic chemistry, and medicinal and pharmaceutical chemistry described herein are those well known and commonly used in the art. Standard techniques are used for chemical syntheses, chemical analyses, pharmaceutical preparation, formulation, and delivery, and treatment of patients.

That the present invention may be more readily understood, select terms are defined below.

and fragments and variants (including fragments of variants) thereof, unless otherwise contradicted by context. For an antigenic polypeptide, a fragment of polypeptide optionally contains at least one contiguous or nonlinear epitope of polypeptide. The precise boundaries of the at least one epitope fragment can be confirmed using ordinary skill in the art. The fragment comprises at least about 5 contiguous amino acids, such as at least about 10 contiguous amino acids, at least about 15 contiguous amino acids, or at least about 20 contiguous amino acids. A variant of polypeptide is as described herein.

The term "isolated protein" or "isolated polypeptide" is a protein or polypeptide that by virtue of its origin or source of derivation is not associated with naturally associated components that accompany it in its native state; is substantially free of other proteins from the same species; is expressed by a cell from a different species; or does not occur in nature. Thus, a polypeptide that is chemically synthesized or synthesized in a cellular system different from the cell from which it naturally originates will be "isolated" from its naturally associated components. A protein may also be rendered substantially free of naturally associated components by isolation, using protein purification techniques well known in the art.

The term "recovering" as used herein, refers to the process of rendering a chemical species such as a polypeptide substantially free of naturally associated components by isolation, e.g., using protein purification techniques well known in the art.

The term "human IL-17" (abbreviated herein as "hIL-17"), as used herein, includes a dimeric cytokine protein. The term includes a homodimeric protein comprising two 15 kD IL-17A proteins. The homodimeric protein is referred to as an "IL-17 protein". The term human "IL-17" is intended to include recombinant human IL-17 (rhIL-17) which can be prepared by standard recombinant expression methods. The sequence of human IL-17A is shown in Table 1.

The term "human IL-17A/F", identical to "hIL-17A/F", as used herein, includes the 15 kD human IL-17A and the 15 kD subunit of the human cytokine IL-17F. The amino acid sequences of human IL-17A and IL-17F are shown in Table 1.

TABLE 1

Sequence of Human IL-17A and Human IL-17F.

| Protein | Sequence Identifier | Sequence 123456789012345678901234567890012 |
|---|---|---|
| Human IL-17A | SEQ ID NO.: 1 | GITIPRNPGCPNSEDKNFPRTVMVNLNIHNRN TNTNPKRSSDYYNRSTSPWNLHRNEDPERYPS VIWEAKCRHLGCINADGNVDYHMNSVPIQQEI LVLRREPPHCPNSFRLEKILVSVGCTCVTPIV HHVA |
| Human IL-17F | SEQ ID NO.: 2 | RKIPKVGHTFFQKPESCPPVPGGSMKLDIGII NENQRVSMSRNIESRSTSPWNYTVTWDPNRYP SEVVQAQCRNLGCINAQGKEDISMNSVPIQQE TLVVRRKHQGCSVSFQLEKVLVTVGCTCVTPV IHHVQ |

The term "polypeptide" as used herein, refers to any polymeric chain of amino acids. The terms "peptide" and "protein" are used interchangeably with the term polypeptide and also refer to a polymeric chain of amino acids. The term "polypeptide" encompasses native or artificial proteins, protein fragments and polypeptide analogs of a protein sequence. A polypeptide may be monomeric or polymeric. Use of "polypeptide" herein is intended to encompass polypeptide "Biological activity" as used herein, refers to all inherent biological properties of the cytokine. Biological properties of IL-17A and IL-17A/F include, but are not limited to, binding to an IL-17 receptor.

The terms "specific binding" or "specifically binding", as used herein, in reference to the interaction of an antibody, a protein, or a peptide with a second chemical species, mean that the interaction is dependent upon the presence of a particular structure (e.g., an antigenic determinant or epitope) on the chemical species; for example, an antibody recognizes and binds to a specific protein structure rather than to proteins generally. If an antibody is specific for epitope "A", the presence of a molecule containing epitope A (or free, unlabeled A), in a reaction containing labeled "A" and the antibody, will reduce the amount of labeled A bound to the antibody.

The term "antibody", as used herein, broadly refers to any immunoglobulin (Ig) molecule comprised of four polypeptide chains, two heavy (H) chains and two light (L) chains, or any functional fragment, mutant, variant, or derivation thereof, which retains the essential epitope binding features of an Ig molecule. Such mutant, variant, or derivative antibody formats are known in the art. Nonlimiting embodiments of which are discussed below.

In a full-length antibody, each heavy chain is comprised of a heavy chain variable region (abbreviated herein as HCVR or VH) and a heavy chain constant region. The heavy chain constant region is comprised of three domains: CH1, CH2, and CH3. Each light chain is comprised of a light chain variable region (abbreviated herein as LCVR or VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. Immunoglobulin molecules can be of any type (e.g., IgG, IgE, IgM, IgD, IgA and IgY), class (e.g., IgG 1, IgG2, IgG 3, IgG4, IgA1 and IgA2) or subclass.

The term "Fc region" is used to define the C-terminal region of an immunoglobulin heavy chain, which may be generated by papain digestion of an intact antibody. The Fc region may be a native sequence Fc region or a variant Fc region. The Fc region of an immunoglobulin generally comprises two constant domains, a CH2 domain, and a CH3 domain, and optionally comprises a CH4 domain. Replacements of amino acid residues in the Fc portion to alter antibody effector function are known in the art (Winter et al., U.S. Pat. Nos. 5,648,260 and 5,624,821). The Fc portion of an antibody mediates several important effector functions, for example, cytokine induction, ADCC, phagocytosis, complement dependent cytotoxicity (CDC), and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered. The dimerization of two identical heavy chains of an immunoglobulin is mediated by the dimerization of CH3 domains and is stabilized by the disulfide bonds within the hinge region (Huber et al. *Nature*, 264: 415-20; Thies et al 1999 *J. Mol. Biol.*, 293: 67-79.). Mutation of cysteine residues within the hinge regions to prevent heavy chain-heavy chain disulfide bonds will destabilize dimeration of CH3 domains. Residues responsible for CH3 dimerization have been identified (Dall'Acqua 1998 *Biochemistry*, 37: 9266-9273.). Therefore, it is possible to generate a monovalent half-Ig. Interestingly, these monovalent half Ig molecules have been found in nature for both IgG and IgA subclasses (Seligman 1978 *Ann. Immunol.*, 129: 855-70; Biewenga et al 1983 Clin Exp Immunol 51: 395-400). The stoichiometry of FcRn: Ig Fc region has been determined to be 2:1 (West et al 2000 *Biochemistry*, 39: 9698-708), and half Fc is sufficient for mediating FcRn binding (Kim et al 1994, *Eur. J. Immunol.*, 24: 542-548.). Mutations to disrupt the dimerization of CH3 domain may not have greater adverse effect on its FcRn binding as the residues important for CH3 dimerization are located on the inner interface of CH3 b sheet structure, whereas the region responsible for FcRn binding is located on the outside interface of CH2-CH3 domains. However, the half Ig molecule may have certain advantage in tissue penetration due to its smaller size than that of a regular antibody. In one embodiment, at least one amino acid residue is replaced in the constant region of the binding protein of the invention, for example the Fc region, such that the dimerization of the heavy chains is disrupted, resulting in half DVD Ig molecules. The anti-inflammatory activity of IgG is completely dependent on sialylation of the N-linked glycan of the IgG Fc fragment. The precise glycan requirements for anti-inflammatory activity has been determined, such that an appropriate IgG1 Fc fragment can be created, thereby generating a fully recombinant, sialylated IgG1 Fc with greatly enhanced potency (Anthony, R. M., et al. (2008) Science 320:373-376).

The term "antigen-binding portion" of an antibody (or simply "antibody portion"), as used herein, refers to one or more fragments of an antibody that retain the ability to specifically bind to an antigen (e.g., hIL-17). It has been shown that the antigen-binding function of an antibody can be performed by fragments of a full-length antibody. Such antibody embodiments may also be bispecific, dual specific, or multi-specific formats; specifically binding to two or more different antigens. Examples of binding fragments encompassed within the term "antigen-binding portion" of an antibody include (i) a Fab fragment, a monovalent fragment consisting of the VL, VH, CL, and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature*, 341:544-546, Winter et al., PCT Publication No. WO 90/05144 A1 herein incorporated by reference), which comprises a single variable domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain Fv (scFv); see, for example, Bird et al. (1988) *Science*, 242: 423-426 and Huston et al. (1988) *Proc. Natl. Acad. Sci. USA*, 85: 5879-5883). Such single chain antibodies are also intended to be encompassed within the term "antigen-binding portion" of an antibody. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see, for example, Holliger, et al. (1993) *Proc. Natl. Acad. Sci. USA*, 90: 6444-6448; Poljak et al. (1994) *Structure*, 2: 1121-1123). Such antibody binding portions are known in the art (Kontermann and Dubel eds., *Anti-* body Engineering (2001) Springer-Verlag. New York. 790 pp. (ISBN 3-540-41354-5)). In addition single chain antibodies also include "linear antibodies" comprising a pair of tandem Fv segments (VH-CH1-VH-CH1) which, together with complementary light chain polypeptides, form a pair of antigen binding regions (Zapata et al. Protein Eng. 8(10):1057-1062 (1995); and U.S. Pat. No. 5,641,870).

An immunoglobulin constant (C) domain refers to a heavy (CH) or light (CL) chain constant domain. Murine and human IgG heavy chain and light chain constant domain amino acid sequences are known in the art.

The term "IL-17 binding protein construct" (or "binding protein construct") as used herein refers to a polypeptide comprising one or more of the antigen binding portions of the invention linked to a linker polypeptide or an immunoglobulin constant domain. Linker polypeptides comprise two or more amino acid residues joined by peptide bonds and are used to link one or more antigen binding portions. Such linker polypeptides are well known in the art (see e.g., Holliger et al. (1993) Proc. Natl. Acad. Sci. USA, 90: 6444-6448; Poljak et al., (1994) Structure, 2: 1121-1123). An immunoglobulin constant domain refers to a heavy or light chain constant domain. Human IgG heavy chain and light chain constant domain amino acid sequences are known in the art and represented in Table 2.

region to make a tetrameric scFv molecule (Kipriyanov, S. M., et al. (1995) Human Antibodies and Hybridomas, 6: 93-101) and use of a cysteine residue, a marker peptide and a C-terminal polyhistidine tag to make bivalent and biotinylated scFv molecules (Kipriyanov, S. M., et al. (1994) Mol. Immunol., 31: 1047-1058). Antibody portions, such as Fab and F(ab')$_2$ fragments, can be prepared from whole antibodies using conventional techniques, such as papain or pepsin digestion, respectively, of whole antibodies. Moreover, antibodies, antibody portions and immunoadhesion molecules can be obtained using standard recombinant DNA techniques, as described herein.

An "isolated antibody", as used herein, is intended to refer to an antibody that is substantially free of other antibodies having different antigenic specificities (e.g., an isolated antibody that specifically binds hIL-17 is substantially free of antibodies that specifically bind antigens other than hIL-17). An isolated antibody that specifically binds hIL-17 may, however, have cross-reactivity to other antigens, such as IL-17 molecules from other species. Moreover, an isolated antibody may be substantially free of other cellular material and/or chemicals.

The term "monoclonal antibody" or "mAb" as used herein refers to an antibody obtained from a population of substantially homogeneous antibodies, i.e., the individual antibodies

TABLE 2

Sequence of Human IgG Heavy Chain Constant Domain and Light Chain Constant Domain

| Protein | Sequence Identifier | Sequence<br>123456789012345678901234567890112 |
|---|---|---|
| Ig gamma-1 constant region | SEQ ID NO.: 3 | ASTKGPSVFPLAPSSKSTSGGTAALGCLVKDY<br>FPEPVTVSWNSGALTSGVHTFPAVLQSSGLYS<br>LSSVVTVPSSSLGTQTYICNVNHKPSNTKVDK<br>KVEPKSCDKTHTCPPCPAPELLGGPSVFLFPP<br>KPKDTLMISRTPEVTCVVVDVSHEDPEVKFNW<br>YVDGVEVHNAKTKPREEQYNSTYRVVSVLTVL<br>HQDWLNGKEYKCKVSNKALPAPIEKTISKAKG<br>QPREPQVYTLPPSREEMTKNQVSLTCLVKGFY<br>PSDIAVEWESNGQPENNYKTTPPVLDSDGSFF<br>LYSKLTVDKSRWQQGNVFSCSVMHEALHNHYT<br>QKSLSLSPGK |
| Ig gamma-1 constant region mutant | SEQ ID NO.: 4 | ASTKGPSVFPLAPSSKSTSGGTAALGCLVKDY<br>FPEPVTVSWNSGALTSGVHTFPAVLQSSGLYS<br>LSSVVTVPSSSLGTQTYICNVNHKPSNTKVDK<br>KVEPKSCDKTHTCPPCPAPEAAGGPSVFLFPP<br>KPKDTLMISRTPEVTCVVVDVSHEDPEVKFNW<br>YVDGVEVHNAKTKPREEQYNSTYRVVSVLTVL<br>HQDWLNGKEYKCKVSNKALPAPIEKTISKAKG<br>QPREPQVYTLPPSREEMTKNQVSLTCLVKGFY<br>PSDIAVEWESNGQPENNYKTTPPVLDSDGSFF<br>LYSKLTVDKSRWQQGNVFSCSVMHEALHNHYT<br>QKSLSLSPGK |
| Ig Kappa constant region | SEQ ID NO.: 5 | TVAAPSVFIFPPSDEQLKSGTASVVCLLNNFY<br>PREAKVQWKVDNALQSGNSQESVTEQDSKDST<br>YSLSSTLTLSKADYEKHKVYACEVTHQGLSSP<br>VTKSFNRGEC |
| Ig Lambda constant region | SEQ ID NO.: 6 | QPKAAPSVTLFPPSSEELQANKATLVCLISDF<br>YPGAVTVAWKADSSPVKAGVETTTPSKQSNNK<br>YAASSYLSLTPEQWKSHRSYSCQVTHEGSTVE<br>KTVAPTECS |

Still further, an IL-17 binding protein, such as an antibody or antigen-binding portion thereof, may be part of a larger immunoadhesion molecule, formed by covalent or noncovalent association of the antibody or antibody portion with one or more other proteins or peptides. Examples of such immunoadhesion molecules include use of the streptavidin core comprising the population are identical except for possible naturally occurring mutations that may be present in minor amounts. Monoclonal antibodies are highly specific, being directed against a single antigen. Furthermore, in contrast to polyclonal antibody preparations that typically include different antibodies directed against different determinants (epitopes), each mAb is directed against a single determinant on the antigen. The modifier "monoclonal" is not to be construed as requiring production of the antibody by any particular method.

The term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The term "recombinant human antibody", as used herein, is intended to include all human antibodies that are prepared, expressed, created or isolated by recombinant means, such as antibodies expressed using a recombinant expression vector transfected into a host cell (described further in Section II C, below), antibodies isolated from a recombinant, combinatorial human antibody library (Hoogenboom H. R., (1997) *TIB Tech.*, 15: 62-70; Azzazy H., and Highsmith W. E., (2002) *Clin. Biochem.*, 35: 425-445; Gavilondo J. V., and Larrick J. W. (2002) *BioTechniques*, 29: 128-145; Hoogenboom H., and Chames P. (2000) *Immunology Today*, 21: 371-378), antibodies isolated from an animal (e.g., a mouse) that is transgenic for human immunoglobulin genes (see, e.g., Taylor, L. D., et al. (1992) *Nucl. Acids Res.*, 20: 6287-6295; Kellermann S-A., and Green L. L. (2002) *Current Opinion in Biotechnology*, 13: 593-597; Little M. et al (2000) *Immunology Today*, 21: 364-370) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "chimeric antibody" refers to antibodies that comprise heavy and light chain variable region sequences from one species and constant region sequences from another species, such as antibodies having murine heavy and light chain variable regions linked to human constant regions.

The term "CDR-grafted antibody" refers to antibodies that comprise heavy and light chain variable region sequences from one species but in which the sequences of one or more of the CDR regions of VH and/or VL are replaced with CDR sequences of another species, such as antibodies having murine heavy and light chain variable regions in which one or more of the murine CDRs (e.g., CDR3) has been replaced with human CDR sequences.

The terms "Kabat numbering", "Kabat definitions", and "Kabat labeling" are used interchangeably herein. These terms, which are recognized in the art, refer to a system of numbering amino acid residues which are more variable (i.e., hypervariable) than other amino acid residues in the heavy and light chain variable regions of an antibody, or an antigen binding portion thereof (Kabat et al. (1971) *Ann. NY Aca., Sci.*, 190: 382-391 and Kabat, E. A., et al. (1991) *Sequences of Proteins of Immunological Interest*, Fifth Edition, U.S. Department of Health and Human Services, NIH Publication No. 91-3242). For the heavy chain variable region, the hypervariable region ranges from amino acid positions 31 to 35 for CDR1, amino acid positions 50 to 65 for CDR2, and amino acid positions 95 to 102 for CDR3. For the light chain variable region, the hypervariable region ranges from amino acid positions 24 to 34 for CDR1, amino acid positions 50 to 56 for CDR2, and amino acid positions 89 to 97 for CDR3.

As used herein, the term "CDR" refers to the complementarity determining region within antibody variable sequences. There are three CDRs in each of the variable regions of the heavy chain and the light chain, which are designated CDR1, CDR2 and CDR3, for each of the variable regions. The term "CDR set" as used herein refers to a group of three CDRs that occur in a single variable region capable of binding the antigen. The exact boundaries of these CDRs have been defined differently according to different systems. The system described by Kabat (Kabat et al., Sequences of Proteins of Immunological Interest (National Institutes of Health, Bethesda, Md. (1987) and (1991)) not only provides an unambiguous residue numbering system applicable to any variable region of an antibody, but also provides precise residue boundaries defining the three CDRs. These CDRs may be referred to as Kabat CDRs. Chothia and coworkers (Chothia and Lesk, *J. Mol. Biol.*, 196: 901-917 (1987) and Chothia et al., *Nature*, 342: 877-883 (1989)) found that certain subportions within Kabat CDRs adopt nearly identical peptide backbone conformations, despite having great diversity at the level of amino acid sequence. These sub-portions were designated as L1, L2, and L3 or H1, H2, and H3 where the "L" and the "H" designates the light chain and the heavy chains regions, respectively. These regions may be referred to as Chothia CDRs, which have boundaries that overlap with Kabat CDRs. Other boundaries defining CDRs overlapping with the Kabat CDRs have been described by Padlan (*FASEB J.*, 9: 133-139 (1995)) and MacCallum (*J. Mol. Biol.*, 262(5): 732-45 (1996)). Still other CDR boundary definitions may not strictly follow one of the above systems, but will nonetheless overlap with the Kabat CDRs, although they may be shortened or lengthened in light of prediction or experimental findings that particular residues or groups of residues or even entire CDRs do not significantly impact antigen binding. The methods used herein may utilize CDRs defined according to any of these systems, although preferred embodiments use Kabat or Chothia defined CDRs.

As used herein, the term "canonical" residue refers to a residue in a CDR or framework that defines a particular canonical CDR structure as defined by Chothia et al. (*J. Mol. Biol.*, 196: 901-907 (1987); Chothia et al., *J. Mol. Biol.*, 227: 799 (1992), both are incorporated herein by reference). According to Chothia et al., critical portions of the CDRs of many antibodies have nearly identical peptide backbone conformations despite great diversity at the level of amino acid sequence. Each canonical structure specifies primarily a set of peptide backbone torsion angles for a contiguous segment of amino acid residues forming a loop.

An "affinity matured" antibody is an antibody with one or more alterations in one or more CDRs thereof which result in an improvement in the affinity of the antibody for a target antigen, compared to a parent antibody which does not possess the alteration(s). Exemplary affinity matured antibodies will have nanomolar or even picomolar affinities for the target antigen. A variety of procedures for producing affinity matured antibodies are known in the art. For example, Marks et al., *Bio/Technology*, 10: 779-783 (1992) describes affinity maturation by VH and VL domain shuffling. Random mutagenesis of CDR and/or framework residues is described by Barbas et al., *Proc. Nat. Acad. Sci. USA,* 91: 3809-3813 (1994); Schier et al., *Gene,* 169: 147-155 (1995); Yelton et al., *J. Immunol.,* 155: 1994-2004 (1995); Jackson et al., *J. Immunol.,* 154(7): 3310-3319 (1995); Hawkins et al, *J. Mol. Biol.,* 226: 889-896 (1992). Selective mutation at selective mutagenesis positions and at contact or hypermutation positions with an activity enhancing amino acid residue is described in U.S. Pat. No. 6,914,128B1.

The term "multivalent binding protein" denotes a binding protein comprising two or more antigen binding sites. A multivalent binding protein is preferably engineered to have three or more antigen binding sites, and is generally not a naturally occurring antibody. The term "multispecific binding protein" refers to a binding protein capable of binding two or more related or unrelated targets. "Dual variable domain" ("DVD") binding proteins of the invention comprise two or more antigen binding sites and are tetravalent or multivalent binding proteins. DVDs may be monospecific, i.e., capable of binding one antigen, or multispecific, i.e., capable of binding two or more antigens. A DVD binding protein comprising two heavy chain DVD polypeptides and two light chain DVD polypeptides is referred to as a "DVD immunoglobulin" or "DVD-Ig". Each half of a DVD-Ig comprises a heavy chain DVD polypeptide and a light chain DVD polypeptide, and two or more antigen binding sites. Each binding site comprises a heavy chain variable domain and a light chain variable domain with a total of six CDRs involved in antigen binding per antigen binding site.

A description of the design, expression, and characterization of DVD-Ig molecules is provided in PCT Publication No. WO 2007/024715, U.S. Pat. No. 7,612,181, and Wu et al., *Nature Biotech.,* 25: 1290-1297 (2007). A preferred example of such DVD-Ig molecules comprises a heavy chain that comprises the structural formula VD1-(X1)n-VD2-C-(X2)n, wherein VD1 is a first heavy chain variable domain, VD2 is a second heavy chain variable domain, C is a heavy chain constant domain, X1 is a linker with the proviso that it is not CH1, X2 is an Fc region, and n is 0 or 1, but preferably 1; and a light chain that comprises the structural formula VD1-(X1)n-VD2-C-(X2)n, wherein VD1 is a first light chain variable domain, VD2 is a second light chain variable domain, C is a light chain constant domain, X1 is a linker with the proviso that it is not CH1, and X2 does not comprise an Fc region; and n is 0 or 1, but preferably 1. Such a DVD-Ig may comprise two such heavy chains and two such light chains, wherein each chain comprises variable domains linked in tandem without an intervening constant region between variable regions, wherein a heavy chain and a light chain associate to form tandem functional antigen binding sites, and a pair of heavy and light chains may associate with another pair of heavy and light chains to form a tetrameric binding protein with four functional antigen binding sites. In another example, a DVD-Ig molecule may comprise heavy and light chains that each comprise three variable domains (VD1, VD2, VD3) linked in tandem without an intervening constant region between variable domains, wherein a pair of heavy and light chains may associate to form three antigen binding sites, and wherein a pair of heavy and light chains may associate with another pair of heavy and light chains to form a tetrameric binding protein with six antigen binding sites.

A DVD-Ig binding protein may bind one or more epitopes of IL-17, the IL-17A monomer, the IL-17F monomer, and dimers thereof. A DVD-Ig binding protein may also bind an epitope of IL-17 and an epitope of a second target antigen other than an IL-17A and/or IL-17F polypeptide.

The term "bispecific antibody", as used herein, refers to full-length antibodies that are generated by quadroma technology (see Milstein, C. and A. C. Cuello, Nature, 1983. 305(5934): p. 537-40), by chemical conjugation of two different monoclonal antibodies (see Staerz, U. D., et al., Nature, 1985. 314(6012): p. 628-31), or by knob-into-hole or similar approaches which introduces mutations in the Fc region (see Holliger et al., *Proc. Natl. Acad. Sci. USA,* 1993, 90(14): 6444-6448), resulting in multiple different immunoglobulin species of which only one is the functional bispecific antibody. By molecular function, a bispecific antibody binds one antigen (or epitope) on one of its two binding arms (one pair of HC/LC), and binds a different antigen (or epitope) on its second arm (a different pair of HC/LC). By this definition, a bispecific antibody has two distinct antigen binding arms (in both specificity and CDR sequences), and is monovalent for each antigen it binds to.

The term "dual-specific antibody", as used herein, refers to full-length antibodies that can bind two different antigens (or epitopes) in each of its two binding arms (a pair of HC/LC) (see PCT publication WO 02/02773). Accordingly a dual-specific binding protein has two identical antigen binding arms, with identical specificity and identical CDR sequences, and is bivalent for each antigen to which it binds.

A "functional antigen binding site" of a binding protein is one that is capable of binding a target antigen. The antigen binding affinity of the antigen binding site is not necessarily as strong as the parent antibody from which the antigen binding site is derived, but the ability to bind antigen must be measurable using any one of a variety of methods known for evaluating antibody binding to an antigen. Moreover, the antigen binding affinity of each of the antigen binding sites of a multivalent antibody herein need not be quantitatively the same.

The term "cytokine" is a generic term for proteins that are released by one cell population and that act on another cell population as intercellular mediators. Examples of such cytokines are lymphokines, monokines, and traditional polypeptide hormones. Included among the cytokines are growth hormones, such as human growth hormone, N-methionyl human growth hormone, and bovine growth hormone; parathyroid hormone; thyroxine; insulin; proinsulin; relaxin; prorelaxin; glycoprotein hormones, such as follicle stimulating hormone (FSH), thyroid stimulating hormone (TSH), and luteinizing hormone (LH); hepatic growth factor; fibroblast growth factor; prolactin; placental lactogen; a tumor necrosis factor such as tumor necrosis factor-alpha (TNF-α) and tumor necrosis factor-beta (TNF-β); mullerian-inhibiting substance; mouse gonadotropin-associated peptide; inhibin; activin; vascular endothelial growth factor; integrin; thrombopoietin (TPO); nerve growth factors such as NGF-alpha (NGF-α); platelet-growth factor; placental growth factor; transforming growth factors (TGFs) such as TGF-alpha (TGF-α) and TGF-beta (TGF-β); insulin-like growth factor-1 and -11; erythropoietin (EPO); osteoinductive factors; interferons such as interferon-alpha (IFN-α), interferon-beta (IFN-β), and interferon-gamma (IFN-γ); colony stimulating factors (CSFs) such as macrophage-CSF (M-CSF); granulocyte macrophage-CSF (GM-CSF); and granulocyte-CSF (G-CSF); interleukins (ILs) such as IL-1, IL-2, IL-3, IL-4, IL-5, IL-6, IL-7, IL-8, IL-9, IL-10, IL-11, IL-12, IL-13, IL-15, IL-17, IL-18, IL-21, IL-22, IL-23, IL-33; and other polypeptide factors including LIF and kit ligand (KL). As used herein, the term cytokine includes proteins from natural sources or from recombinant cell culture and biologically active equivalents of the native sequence cytokines.

As used herein, the terms "donor" and "donor antibody" refer to an antibody providing one or more CDRs. In a preferred embodiment, the donor antibody is an antibody from a species different from the antibody from which the framework regions are obtained or derived. In the context of a humanized antibody, the term "donor antibody" refers to a non-human antibody providing one or more CDRs.

As used herein, the term "framework" or "framework sequence" refers to the remaining sequences of a variable region minus the CDRs. Because the exact definition of a CDR sequence can be determined by different systems, the meaning of a framework sequence is subject to correspondingly different interpretations. The six CDRs (CDR-L1, -L2, and -L3 of light chain and CDR-H1, -H2, and -H3 of heavy chain) also divide the framework regions on the light chain and the heavy chain into four sub-regions (FR1, FR2, FR3 and FR4) on each chain, in which CDR1 is positioned between FR1 and FR2, CDR2 between FR2 and FR3, and CDR3 between FR3 and FR4. Without specifying the particular sub-regions as FR1, FR2, FR3 or FR4, a framework region, as referred by others, represents the combined FR's within the variable region of a single, naturally occurring immunoglobulin chain. As used herein, a FR represents one of the four sub-regions, and FRs represents two or more of the four sub-regions constituting a framework region.

As used herein, the terms "acceptor" and "acceptor antibody" refer to the antibody providing or nucleic acid sequence encoding at least 80%, at least 85%, at least 90%, at least 95%, at least 98%, or 100% of the amino acid sequences of one or more of the framework regions. In some embodiments, the term "acceptor" refers to the antibody amino acid providing or nucleic acid sequence encoding the constant region(s). In yet another embodiment, the term "acceptor" refers to the antibody amino acid providing or nucleic acid sequence encoding one or more of the framework regions and the constant region(s). In a specific embodiment, the term "acceptor" refers to a human antibody amino acid or nucleic acid sequence that provides or encodes at least 80%, preferably, at least 85%, at least 90%, at least 95%, at least 98%, or 100% of the amino acid sequences of one or more of the framework regions. In accordance with this embodiment, an acceptor may contain at least 1, at least 2, at least 3, least 4, at least 5, or at least 10 amino acid residues that does (do) not occur at one or more specific positions of a human antibody. An acceptor framework region and/or acceptor constant region(s) may be, e.g., derived or obtained from a germline antibody gene, a mature antibody gene, a functional antibody (e.g., antibodies well known in the art, antibodies in development, or antibodies commercially available).

Human heavy chain and light chain acceptor sequences are known in the art. In one embodiment of the invention the human heavy chain and light chain acceptor sequences are selected from the sequences listed from V-base (http://vbase.mrc-cpe.cam.ac.uk/) or from IMGT®, the international ImMunoGeneTics information System® (http://imgt-.cines.fr/textes/IMGTrepertoire/LocusGenes/). In another embodiment of the invention the human heavy chain and light chain acceptor sequences are selected from the sequences described in Table 3 and Table 4.

TABLE 3

Heavy Chain Acceptor Sequences

| SEQ ID No. | Protein region | Sequence 12345678901234567890123456789012 |
|---|---|---|
| 7 | VH1-69 FR1 | QVQLVQSGAEVKKPGSSVKVSCKASGGTFS |
| 8 | VH1-69 FR2 | WVRQAPGQGLEWMG |

TABLE 3-continued

Heavy Chain Acceptor Sequences

| SEQ ID No. | Protein region | Sequence 12345678901234567890123456789012 |
|---|---|---|
| 9 | VH1-69 FR3 | RVTITADKSTSTAYMELSSLRSEDTAVYYCAR |
| 10 | JH1/JH4/JH5 FR4 | WGQGTLVTVSS |
| 11 | JH3 FR4 | WGQGTMVTVSS |
| 12 | JH6 FR4 | WGQGTTVTVSS |

TABLE 4

Light Chain Acceptor Sequences

| SEQ ID No. | Protein region | Sequence 12345678901234567890123456789012 |
|---|---|---|
| 13 | 1-17/A30 FR1 | DIQMTQSPSSLSASVGDRVTITC |
| 14 | 1-17/A30 FR2 | WYQQKPGKAPKRLIY |
| 15 | 1-17/A30 FR3 | GVPSRFSGSGSGTEFTLTISSLQPEDFATYYC |
| 16 | 6-21/A26 FR1 | EIVLTQSPDFQSVTPKEKVTITC |
| 17 | 6-21/A26 FR2 | WYQQKPDQSPKLLIK |
| 18 | 6-21/A26 FR3 | GVPSRFSGSGSGTDFTLTINSLEAEDAATYYC |
| 13 | 1-33/O18 FR1 | DIQMTQSPSSLSASVGDRVTITC |
| 19 | 1-33/O18 FR2 | WYQQKPGKAPKLLIY |
| 20 | 1-33/O18 FR3 | GVPSRFSGSGSGTDFTFTISSLQPEDIATYYC |
| 21 | 3-15/L2 FR1 | EIVMTQSPATLSVSPGERATLSC |
| 22 | 3-15/L2 FR2 | WYQQKPGQAPRLLIY |
| 23 | 3-15/L2 FR3 | GIPARFSGSGSGTEFTLTISSLQSEDFAVYYC |
| 24 | JK2 FR4 | FGQGTKLEIKR |
| 25 | JK4 FR4 | FGGGTKVEIKR |

As used herein, the term "germline antibody gene" or "gene fragment" refers to an immunoglobulin sequence encoded by non-lymphoid cells that have not undergone the maturation process that leads to genetic rearrangement and mutation for expression of a particular immunoglobulin. (See, e.g., Shapiro et al., *Crit. Rev. Immunol.*, 22(3): 183-200 (2002); Marchalonis et al., *Adv. Exp. Med. Biol.*, 484: 13-30 (2001)). One of the advantages provided by various embodiments of the present invention stems from the recognition that germline antibody genes are more likely than mature antibody genes to conserve essential amino acid sequence structures characteristic of individuals in the species, hence less likely to be recognized as from a foreign source when used therapeutically in that species.

As used herein, the term "key" residues refer to certain residues within the variable region that have more impact on the binding specificity and/or affinity of an antibody, in particular a humanized antibody. A key residue includes, but is not limited to, one or more of the following: a residue that is adjacent to a CDR, a potential glycosylation site (can be either N- or O-glycosylation site), a rare residue, a residue capable of interacting with the antigen, a residue capable of interacting with a CDR, a canonical residue, a contact residue between heavy chain variable region and light chain variable region, a residue within the Vernier zone, and a residue in the region that overlaps between the Chothia definition of a variable heavy chain CDR1 and the Kabat definition of the first heavy chain framework.

The term "humanized antibody" refers to antibodies that comprise heavy and light chain variable region sequences from a non-human species (e.g., a mouse) but in which at least a portion of the VH and/or VL sequence has been altered to be more "human-like", i.e., more similar to human germline variable sequences. One type of humanized antibody is a CDR-grafted antibody, in which human CDR sequences are introduced into non-human VH and VL sequences to replace the corresponding nonhuman CDR sequences. Also "humanized antibody" is an antibody or a variant, derivative, analog or fragment thereof which immunospecifically binds to an antigen of interest and which comprises a framework (FR) region having substantially the amino acid sequence of a human antibody and a complementary determining region (CDR) having substantially the amino acid sequence of a non-human antibody. As used herein, the term "substantially" in the context of a CDR refers to a CDR having an amino acid sequence at least 80%, at least 85%, at least 90%, at least 95%, at least 98% or at least 99% identical to the amino acid sequence of a non-human antibody CDR. A humanized antibody comprises substantially all of at least one, and typically two, variable domains (Fab, Fab', F(ab')$_2$, FabC, Fv) in which all or substantially all of the CDR regions correspond to those of a non-human immunoglobulin (i.e., donor antibody) and all or substantially all of the framework regions are those of a human immunoglobulin consensus sequence. In an embodiment, a humanized antibody also comprises at least a portion of an immunoglobulin constant region (Fc), typically that of a human immunoglobulin. In some embodiments, a humanized antibody contains both the light chain as well as at least the variable domain of a heavy chain. The antibody also may include the CH1, hinge, CH2, CH3, and CH4 regions of the heavy chain. In some embodiments, a humanized antibody only contains a humanized light chain. In some embodiments, a humanized antibody only contains a humanized heavy chain. In specific embodiments, a humanized antibody only contains a humanized variable domain of a light chain and/or humanized heavy chain.

A humanized antibody may be selected from any class of immunoglobulins, including IgM, IgG, IgD, IgA and IgE, and any isotype including without limitation IgG1, IgG2, IgG3, and IgG4. The humanized antibody may comprise sequences from more than one class or isotype, and particular constant domains may be selected to optimize desired effector functions using techniques well known in the art.

The framework and CDR regions of a humanized antibody need not correspond precisely to the parental sequences, e.g., the donor antibody CDR or the consensus framework may be mutagenized by substitution, insertion and/or deletion of at least one amino acid residue so that the CDR or framework residue at that site does not correspond to either the donor antibody or the consensus framework. In a preferred embodiment, such mutations, however, will not be extensive. Usually, at least 80%, preferably at least 85%, more preferably at least 90%, and most preferably at least 95% of the humanized antibody residues will correspond to those of the parental FR and CDR sequences. As used herein, the term "consensus framework" refers to the framework region in the consensus immunoglobulin sequence. As used herein, the term "consensus immunoglobulin sequence" refers to the sequence formed from the most frequently occurring amino acids (or nucleotides) in a family of related immunoglobulin sequences (see e.g., Winnaker, From Genes to Clones (Verlagsgesellschaft, Weinheim, Germany 1987)). In a family of immunoglobulins, each position in the consensus sequence is occupied by the amino acid occurring most frequently at that position in the family. If two amino acids occur equally frequently, either can be included in the consensus sequence.

With respect to constructing DVD-Ig or other binding protein molecules, a "linker" is used to denote polypeptides comprising two or more amino acid residues joined by peptide bonds and are used to link one or more antigen binding portions. Such linker polypeptides are well known in the art (see, e.g., Holliger et al. (1993) *Proc. Natl. Acad. Sci. USA*, 90: 6444-6448; Poljak et al. (1994) *Structure*, 2: 1121-1123). Exemplary linkers include, but are not limited to, GGGGSG (SEQ ID NO:887), GGSGG (SEQ ID NO:888), GGGGSGGGGS (SEQ ID NO:889), GGSGGGGSGS (SEQ ID NO:890), GGSGGGGSGGGGS (SEQ ID NO:891), GGGGSGGGGSGGGG (SEQ ID NO:892), GGGGSGGGGSGGGGS (SEQ ID NO:893), ASTKGP (SEQ ID NO:894), ASTKGPSVFPLAP (SEQ ID NO:895), TVAAP (SEQ ID NO:896), TVAAPSVFIFPP (SEQ ID NO:897), AKTTPKLEEGEFSEAR (SEQ ID NO:898), AKTTPKLEEGEFSEARV (SEQ ID NO:899), AKTTPKLGG (SEQ ID NO:900), SAKTTPKLGG (SEQ ID NO:901), SAKTTP (SEQ ID NO:902), RADAAP (SEQ ID NO:903), RADAAPTVS (SEQ ID NO:904), RADAAAAGGPGS (SEQ ID NO:905), RADAAAAGGGGSGGGGSGGGGSGGGGS (SEQ ID NO:906), SAKTTPKLEEGEFSEARV (SEQ ID NO:907), ADAAP (SEQ ID NO:908), ADAAPTVSIFPP (SEQ ID NO:909), QPKAAP (SEQ ID NO:910), QPKAAPSVTLFPP (SEQ ID NO:911), AKTTPP (SEQ ID NO:912), AKTTPPSVTPLAP (SEQ ID NO:913), AKTTAP (SEQ ID NO:914), AKTTAPSVYPLAP (SEQ ID NO:915), GENKVEYAPALMALS (SEQ ID NO:916), GPAKELTPLKEAKVS (SEQ ID NO:917), and GHEAAAVMQVQYPAS (SEQ ID NO:918).

As used herein, "Vernier" zone refers to a subset of framework residues that may adjust CDR structure and fine-tune the fit to antigen as described by Foote and Winter (1992, J. Mol. Biol. 224:487-499, which is incorporated herein by reference). Vernier zone residues form a layer underlying the CDRs and may impact on the structure of CDRs and the affinity of the antibody.

As used herein, the term "neutralizing" refers to neutralization of the biological activity of an antigen (e.g., the cytokine IL-17) when a binding protein specifically binds the antigen. Preferably, a neutralizing binding protein described herein binds to hIL-17 and/or hIL-17A/F resulting in the inhibition of a biological activity of hIL-17 and/or hIL-17A/F. Preferably, the neutralizing binding protein binds hIL-17 and/or hIL-17A/F and reduces a biologically activity of hIL-17 and/or hIL-17A/F by at least about 20%, 40%, 60%, 80%, 85%, or more Inhibition of a biological activity of hIL-17 and/or hIL-17A/F by a neutralizing binding protein can be assessed by measuring one or more indicators of hIL-17 and/or hIL-17A/F biological activity well known in the art. For example inhibition of human IL-6 secretion by IL-17 induction in HS27 cells.

The term "activity" includes activities such as the binding specificity/affinity of an antibody for an antigen, for example, an anti-hIL-17 antibody that binds to an IL-17 antigen and/or the neutralizing potency of an antibody, for example, an antihIL-17 antibody whose binding to hIL-17 inhibits the biological activity of hIL-17, for example, inhibition of human IL-6 secretion by IL-17 induction in HS27 cells.

The term "epitope" includes any polypeptide determinant capable of specific binding to an immunoglobulin or T-cell receptor. In certain embodiments, epitope determinants include chemically active surface groupings of molecules such as amino acids, sugar side chains, phosphoryl, or sulfonyl, and, in certain embodiments, may have specific three dimensional structural characteristics, and/or specific charge characteristics. An epitope is a region of an antigen that is bound by an antibody. In certain embodiments, an antibody is said to specifically bind an antigen when it preferentially recognizes its target antigen in a complex mixture of proteins and/or macromolecules. Antibodies are said to "bind to the same epitope" if the antibodies cross-compete (one prevents the binding or modulating effect of the other). In addition, structural definitions of epitopes (overlapping, similar, identical) are informative, but functional definitions are often more relevant as they encompass structural (binding) and functional (modulation, competition) parameters.

The term "surface plasmon resonance", as used herein, refers to an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.). For further descriptions, see Jönsson, U., et al. (1993) *Ann. Biol. Clin.*, 51: 19-26; Jönsson et al., (1991) *BioTechniques*, 11: 620-627; Johnsson et al., (1995) *J. Mol. Recognit.*, 8: 125-131; and Johnnson et al. (1991) *Anal. Biochem.*, 198: 268-277.

The term "$K_{on}$" (also "Kon", "kon"), as used herein, is intended to refer to the on rate constant for association of a binding protein (e.g., an antibody) to an antigen to form an association complex, e.g., antibody/antigen complex, as is known in the art. The "Kon" also is known by the terms "association rate constant", or "ka", as used interchangeably herein. This value indicates the binding rate of an antibody to its target antigen or the rate of complex formation between an antibody and antigen as is shown by the equation below:

$$\text{Antibody("Ab")} + \text{Antigen("Ag")} \rightarrow \text{Ab-Ag.}$$

The term "$K_{off}$" (also "Koff", "koff"), as used herein, is intended to refer to the off rate constant for dissociation, or "dissociation rate constant", of a binding protein (e.g., an antibody) from an association complex (e.g., an antibody/antigen complex) as is known in the art. This value indicates the dissociation rate of an antibody from its target antigen or separation of Ab-Ag complex over time into free antibody and antigen as shown by the equation below:

$$\text{Ab} + \text{Ag} \leftarrow \text{Ab-Ag.}$$

The term "$K_D$" (also "$K_d$"), as used herein, is intended to refer to the "equilibrium dissociation constant", and refers to the value obtained in a titration measurement at equilibrium, or by dividing the dissociation rate constant (Koff) by the association rate constant (Kon). The association rate constant (Kon), the dissociation rate constant (Koff), and the equilibrium dissociation constant (K are used to represent the binding affinity of an antibody to an antigen. Methods for determining association and dissociation rate constants are well known in the art. Using fluorescence-based techniques offers high sensitivity and the ability to examine samples in physiological buffers at equilibrium. Other experimental approaches and instruments such as a BIAcore® (biomolecular interaction analysis) assay can be used (e.g., instrument available from BIAcore International AB, a GE Healthcare company, Uppsala, Sweden). Additionally, a KinExA® (Kinetic Exclusion Assay) assay, available from Sapidyne Instruments (Boise, Id.) can also be used.

The terms "label" and "detectable label" mean a moiety attached to a specific binding partner, such as an antibody or an analyte, e.g., to render the reaction between members of a specific binding pair, such as an antibody and an analyte, detectable. The specific binding partner, e.g., antibody or analyte, so labeled is referred to as "detectably labeled". Thus, the term "labeled binding protein" as used herein, refers to a protein with a label incorporated that provides for the identification of the binding protein. In an embodiment, the label is a detectable marker that can produce a signal that is detectable by visual or instrumental means, e.g., incorporation of a radiolabeled amino acid or attachment to a polypeptide of biotinyl moieties that can be detected by marked avidin or streptavidin (e.g., streptavidin containing a fluorescent marker or enzymatic activity that can be detected by optical or colorimetric methods). Examples of labels for polypeptides include, but are not limited to, the following: radioisotopes or radionuclides (e.g., $^{3}H$ $^{14}C$, $^{35}S$, $^{90}Y$, $^{99}Tc$, $^{111}In$, $^{125}I$, $^{131}I$, $^{177}Lu$, $^{166}Ho$, $^{153}Sm$), chromogens, fluorescent labels (e.g., FITC, rhodamine, lanthanide phosphors), enzymatic labels (e.g., horseradish peroxidase, luciferase, alkaline phosphatase), chemiluminescent markers, biotinyl groups, predetermined polypeptide epitopes recognized by a secondary reporter (e.g., leucine zipper pair sequences, binding sites for secondary antibodies, metal binding domains, epitope tags), and magnetic agents (e.g., gadolinium chelates). Representative examples of labels commonly employed for immunoassays include moieties that produce light, e.g., acridinium compounds, and moieties that produce fluorescence, e.g., fluorescein. Other labels are described herein. In this regard, the moiety itself may not be detectably labeled but may become detectable upon reaction with yet another moiety. Use of the term "detectably labeled" is intended to encompass the latter type of detectable labeling.

The term "IL-17 binding protein conjugate" refers to an IL-17 binding protein described herein chemically linked to a second chemical moiety, such as a therapeutic or cytotoxic agent. The term "agent" is used herein to denote a chemical compound, a mixture of chemical compounds, a biological macromolecule, or an extract made from biological materials. Preferably the therapeutic or cytotoxic agents include, but are not limited to, pertussis toxin, taxol, cytochalasin B, gramicidin D, ethidium bromide, emetine, mitomycin, etoposide, tenoposide, vincristine, vinblastine, colchicine, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. When employed in the context of an immunoassay, an IL-17 binding protein conjugate may be a detectably labeled antibody, which is used as the detection antibody.

The terms "crystal" and "crystallized" as used herein, refer to a binding protein (e.g., an antibody), or antigen binding portion thereof, that exists in the form of a crystal. Crystals are one form of the solid state of matter that is distinct from other forms such as the amorphous solid state or the liquid crystalline state. Crystals are composed of regular, repeating, three-dimensional arrays of atoms, ions, molecules (e.g., proteins such as antibodies), or molecular assemblies (e.g., antigen/antibody complexes). These three-dimensional arrays are arranged according to specific mathematical relationships that are well-understood in the field. The fundamental unit, or building block, that is repeated in a crystal is called the asymmetric unit. Repetition of the asymmetric unit in an arrangement that conforms to a given, well-defined crystallographic symmetry provides the "unit cell" of the crystal. Repetition of the unit cell by regular translations in all three dimensions provides the crystal. See Giegé et al., Chapter 1, In *Crystallization of Nucleic Acids and Proteins, a Practical Approach*, 2nd ed., (Ducruix and Giegé, eds.) (Oxford University Press, New York, 1999) pp. 1-16.

The term "polynucleotide" means a polymeric form of two or more nucleotides, either ribonucleotides or deoxynucleotides or a modified form of either type of nucleotide. The term includes single and double stranded forms of DNA.

The term "isolated polynucleotide" shall mean a polynucleotide (e.g., of genomic, cDNA, or synthetic origin, or some combination thereof) that, by virtue of its origin, the "isolated polynucleotide" is not associated with all or a portion of a polynucleotide with which the "isolated polynucleotide" is found in nature; is operably linked to a polynucleotide that it is not linked to in nature; or does not occur in nature as part of a larger sequence.

The term "vector", as used herein, is intended to refer to a nucleic acid molecule capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" (or simply, "expression vectors"). In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences. "Operably linked" sequences include both expression control sequences that are contiguous with the gene of interest and expression control sequences that act in trans or at a distance to control the gene of interest. The term "expression control sequence" as used herein refers to polynucleotide sequences that are necessary to effect the expression and processing of coding sequences to which they are ligated. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (i.e., Kozak consensus sequence); sequences that enhance protein stability; and when desired, sequences that enhance protein secretion. The nature of such control sequences differs depending upon the host organism; in prokaryotes, such control sequences generally include promoter, ribosomal binding site, and transcription termination sequence; in eukaryotes, generally, such control sequences include promoters and transcription termination sequence. The term "control sequences" is intended to include components whose presence is essential for expression and processing, and can also include additional components whose presence is advantageous, for example, leader sequences and fusion partner sequences.

"Transformation", as defined herein, refers to any process by which exogenous DNA enters a host cell. Transformation may occur under natural or artificial conditions using various methods well known in the art. Transformation may rely on any known method for the insertion of foreign nucleic acid sequences into a prokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time.

The term "recombinant host cell" (or simply "host cell"), is intended to refer to a cell into which exogenous DNA has been introduced. In an embodiment, the host cell comprises two or more (e.g., multiple) nucleic acids encoding antibodies, such as the host cells described in U.S. Pat. No. 7,262,028, for example. Such terms are intended to refer not only to the particular subject cell, but also to the progeny of such a cell. Because certain modifications may occur in succeeding generations due to either mutation or environmental influences, such progeny may not, in fact, be identical to the parent cell, but are still included within the scope of the term "host cell" as used herein. In an embodiment, host cells include prokaryotic and eukaryotic cells selected from any of the Kingdoms of life. In another embodiment, eukaryotic cells include protist, fungal, plant and animal cells. In another embodiment, host cells include but are not limited to the prokaryotic cell line *Escherichia coli*; mammalian cell lines CHO, HEK 293, COS, NS0, SP2 and PER.C6; the insect cell line Sf9; and the fungal cell *Saccharomyces cerevisiae*.

Standard techniques may be used for recombinant DNA, oligonucleotide synthesis, and tissue culture and transformation (e.g., electroporation, lipofection). Enzymatic reactions and purification techniques may be performed according to manufacturer's specifications or as commonly accomplished in the art or as described herein. The foregoing techniques and procedures may be generally performed according to conventional methods well known in the art and as described in various general and more specific references that are cited and discussed throughout the present specification. See e.g., Sambrook et al., *Molecular Cloning: A Laboratory Manual*, 2nd ed. (Cold Spring Harbor Laboratory Press, Cold Spring Harbor, N.Y., 1989).

"Transgenic organism", as known in the art, refers to an organism having cells that contain a transgene, wherein the transgene introduced into the organism (or an ancestor of the organism) expresses a polypeptide not naturally expressed in the organism. A "transgene" is a DNA construct, which is stably and operably integrated into the genome of a cell from which a transgenic organism develops, directing the expression of an encoded gene product in one or more cell types or tissues of the transgenic organism.

The terms "regulate" and "modulate" are used interchangeably, and, as used herein, refers to a change or an alteration in the activity of a molecule of interest (e.g., the biological activity of hIL-17). Modulation may be an increase or a decrease in the magnitude of a certain activity or function of the molecule of interest. Exemplary activities and functions of a molecule include, but are not limited to, binding characteristics, enzymatic activity, cell receptor activation, and signal transduction.

Correspondingly, the term "modulator," as used herein, is a compound capable of changing or altering an activity or function of a molecule of interest (e.g., the biological activity of hIL-17). For example, a modulator may cause an increase or decrease in the magnitude of a certain activity or function of a molecule compared to the magnitude of the activity or function observed in the absence of the modulator. In certain embodiments, a modulator is an inhibitor, which decreases the magnitude of at least one activity or function of a molecule. Exemplary inhibitors include, but are not limited to, proteins, peptides, antibodies, peptibodies, carbohydrates or small organic molecules. Peptibodies are described, e.g., in WO01/83525.

The term "agonist", as used herein, refers to a modulator that, when contacted with a molecule of interest, causes an increase in the magnitude of a certain activity or function of the molecule compared to the magnitude of the activity or function observed in the absence of the agonist. Particular agonists of interest may include, but are not limited to, IL-17 polypeptides, nucleic acids, carbohydrates, or any other molecule that binds to hIL-17.

The terms "antagonist" and "inhibitor", as used herein, refer to a modulator that, when contacted with a molecule of interest causes a decrease in the magnitude of a certain activity or function of the molecule compared to the magnitude of the activity or function observed in the absence of the antagonist. Particular antagonists of interest include those that block or modulate the biological or immunological activity of hIL-17A and/or hIL-17A/F. Antagonists and inhibitors of hIL-17A and/or hIL-17A/F may include, but are not limited to, proteins, nucleic acids, carbohydrates, or any other molecules, which bind to hIL-17A and/or hIL-17A/F.

As used herein, the term "effective amount" refers to the amount of a therapy that is sufficient to reduce or ameliorate the severity and/or duration of a disorder or one or more symptoms thereof; prevent the advancement of a disorder; cause regression of a disorder; prevent the recurrence, development, onset, or progression of one or more symptoms associated with a disorder; detect a disorder; or enhance or improve the prophylactic or therapeutic effect(s) of another therapy (e.g., prophylactic or therapeutic agent).

"Patient" and "subject" may be used interchangeably herein to refer to an animal, such as a mammal, including a primate (for example, a human, a monkey, and a chimpanzee), a non-primate (for example, a cow, a pig, a camel, a llama, a horse, a goat, a rabbit, a sheep, a hamster, a guinea pig, a cat, a dog, a rat, a mouse, a whale), a bird (e.g., a duck or a goose), and a shark. Preferably, a patient or subject is a human, such as a human being treated or assessed for a disease, disorder or condition, a human at risk for a disease, disorder or condition, a human having a disease, disorder or condition, and/or human being treated for a disease, disorder or condition.

The term "sample", as used herein, is used in its broadest sense. A "biological sample", as used herein, includes, but is not limited to, any quantity of a substance from a living thing or formerly living thing. Such living things include, but are not limited to, humans, non-human primates, mice, rats, monkeys, dogs, rabbits and other animals. Such substances include, but are not limited to, blood (e.g., whole blood), plasma, serum, urine, amniotic fluid, synovial fluid, endothelial cells, leukocytes, monocytes, other cells, organs, tissues, bone marrow, lymph nodes and spleen.

"Component", "components," and "at least one component," refer generally to a capture antibody, a detection or conjugate antibody, a control, a calibrator, a series of calibrators, a sensitivity panel, a container, a buffer, a diluent, a salt, an enzyme, a co-factor for an enzyme, a detection reagent, a pretreatment reagent/solution, a substrate (e.g., as a solution), a stop solution, and the like that can be included in a kit for assay of a test sample, such as a patient urine, serum or plasma sample, in accordance with the methods described herein and other methods known in the art. Thus, in the context of the present disclosure, "at least one component," "component," and "components" can include a polypeptide or other analyte as above, such as a composition comprising an analyte such as polypeptide, which is optionally immobilized on a solid support, such as by binding to an anti-analyte (e.g., anti-polypeptide) antibody. Some components can be in solution or lyophilized for reconstitution for use in an assay.

"Control" refers to a composition known to not analyte ("negative control") or to contain analyte ("positive control"). A positive control can comprise a known concentration of analyte. "Control," "positive control," and "calibrator" may be used interchangeably herein to refer to a composition comprising a known concentration of analyte. A "positive control" can be used to establish assay performance characteristics and is a useful indicator of the integrity of reagents (e.g., analytes).

"Predetermined cutoff" and "predetermined level" refer generally to an assay cutoff value that is used to assess diagnostic/prognostic/therapeutic efficacy results by comparing the assay results against the predetermined cutoff/level, where the predetermined cutoff/level already has been linked or associated with various clinical parameters (e.g., severity of disease, progression/nonprogression/improvement, etc.). While the present disclosure may provide exemplary predetermined levels, it is well-known that cutoff values may vary depending on the nature of the immunoassay (e.g., antibodies employed, etc.). It further is well within the ordinary skill of one in the art to adapt the disclosure herein for other immunoassays to obtain immunoassay-specific cutoff values for those other immunoassays based on this disclosure. Whereas the precise value of the predetermined cutoff/level may vary between assays, correlations as described herein (if any) should be generally applicable.

"Pretreatment reagent," e.g., lysis, precipitation and/or solubilization reagent, as used in a diagnostic assay as described herein is one that lyses any cells and/or solubilizes any analyte that is/are present in a test sample. Pretreatment is not necessary for all samples, as described further herein. Among other things, solubilizing the analyte (e.g., polypeptide of interest) may entail release of the analyte from any endogenous binding proteins present in the sample. A pretreatment reagent may be homogeneous (not requiring a separation step) or heterogeneous (requiring a separation step). With use of a heterogeneous pretreatment reagent there is removal of any precipitated analyte binding proteins from the test sample prior to proceeding to the next step of the assay.

"Quality control reagents" in the context of immunoassays and kits described herein, include, but are not limited to, calibrators, controls, and sensitivity panels. A "calibrator" or "standard" typically is used (e.g., one or more, such as a plurality) in order to establish calibration (standard) curves for interpolation of the concentration of an analyte, such as an antibody or an analyte. Alternatively, a single calibrator, which is near a predetermined positive/negative cutoff, can be used. Multiple calibrators (i.e., more than one calibrator or a varying amount of calibrator(s)) can be used in conjunction so as to comprise a "sensitivity panel."

"Risk" refers to the possibility or probability of a particular event occurring either presently or at some point in the future. "Risk stratification" refers to an array of known clinical risk factors that allows physicians to classify patients into a low, moderate, high or highest risk of developing a particular disease, disorder or condition.

"Specific" and "specificity" in the context of an interaction between members of a specific binding pair (e.g., an antigen (or fragment thereof) and an antibody (or antigenically reactive fragment thereof)) refer to the selective reactivity of the interaction. The phrase "specifically binds to" and analogous phrases refer to the ability of antibodies (or antigenically reactive fragments thereof) to bind specifically to analyte (or a fragment thereof) and not bind specifically to other entities.

"Specific binding partner" is a member of a specific binding pair. A specific binding pair comprises two different molecules, which specifically bind to each other through chemical or physical means. Therefore, in addition to antigen and antibody specific binding pairs of common immunoassays, other specific binding pairs can include biotin and avidin (or streptavidin), carbohydrates and lectins, complementary nucleotide sequences, effector and receptor molecules, cofactors and enzymes, enzyme inhibitors and enzymes, and the like. Furthermore, specific binding pairs can include members that are analogs of the original specific binding members, for example, an analyte-analog. Immunoreactive specific binding members include antigens, antigen fragments, and antibodies, including monoclonal and polyclonal antibodies as well as complexes, fragments, and variants (including fragments of variants) thereof, whether isolated or recombinantly produced.

"Variant" as used herein means a polypeptide that differs from a given polypeptide (e.g., IL-17, BNP, NGAL, or HIV polypeptide, or anti-polypeptide antibody) in amino acid sequence by the addition (e.g., insertion), deletion, or conservative substitution of amino acids, but that retains the biological activity of the given polypeptide (e.g., a variant IL-17 can compete with anti-IL-17 antibody for binding to IL-17). A conservative substitution of an amino acid, i.e., replacing an amino acid with a different amino acid of similar properties (e.g., hydrophilicity and degree and distribution of charged regions) is recognized in the art as typically involving a minor change. These minor changes can be identified, in part, by considering the hydropathic index of amino acids, as understood in the art (see, e.g., Kyte et al., *J. Mol. Biol.*, 157: 105-132 (1982)). The hydropathic index of an amino acid is based on a consideration of its hydrophobicity and charge. It is known in the art that amino acids of similar hydropathic indexes can be substituted and still retain protein function. In one aspect, amino acids having hydropathic indexes of ±2 are substituted. The hydrophilicity of amino acids also can be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity (see, e.g., U.S. Pat. No. 4,554,101). Substitution of amino acids having similar hydrophilicity values can result in peptides retaining biological activity, for example immunogenicity, as is understood in the art. In one aspect, substitutions are performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly the side chains of those amino acids, as revealed by the hydrophobicity, hydrophilicity, charge, size, and other properties. "Variant" also can be used to describe a polypeptide or fragment thereof that has been differentially processed, such as by proteolysis, phosphorylation, or other post-translational modification, yet retains its biological activity or antigen reactivity, e.g., the ability to bind to IL-17. Use of "variant" herein is intended to encompass fragments of a variant unless otherwise contradicted by context.

I. Antibodies that Bind Human IL-17.

One aspect of the present invention provides isolated murine monoclonal antibodies, or antigen-binding portions thereof, that bind to IL-17 with high affinity, a slow off rate and high neutralizing capacity. A second aspect of the invention provides chimeric antibodies that bind IL-17. A third aspect of the invention provides CDR grafted antibodies, or antigen-binding portions thereof, that bind IL-17. A fourth aspect of the invention provides humanized antibodies, or antigen-binding portions thereof, that bind IL-17. A fifth aspect of the invention provides dual variable domain immunoglobulin (DVD-Ig™) molecules that bind IL-17 and one other target. Preferably, the antibodies, or portions thereof, are isolated antibodies. Preferably, the antibodies of the invention are neutralizing human anti-IL-17A and/or human anti-IL-17A/F antibodies.

A. Method of Making Anti IL-17 Antibodies

Anti IL-17 antibodies of the present invention may be made by any of a number of techniques known in the art.

1. Anti IL-17 Monoclonal Antibodies Using Hybridoma Technology

Monoclonal antibodies can be prepared using a wide variety of techniques known in the art including the use of hybridoma, recombinant, and phage display technologies, or a combination thereof. For example, monoclonal antibodies can be produced using hybridoma techniques including those known in the art and taught, for example, in Harlow et al., *Antibodies: A Laboratory Manual*, 2nd ed. (Cold Spring Harbor Laboratory Press, 1988); Hammerling, et al., in: *Monoclonal Antibodies and T-Cell Hybridomas* 563-681 (Elsevier, N.Y., 1981) (said references incorporated by reference in their entireties). The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

Methods for producing and screening for specific anti-IL-17 antibodies using hybridoma technology are routine and well known in the art. In one embodiment, the present invention provides methods of generating monoclonal antibodies as well as antibodies produced by the method comprising culturing a hybridoma cell secreting an antibody of the invention wherein, preferably, the hybridoma is generated by fusing splenocytes isolated from a mouse immunized with an antigen of the invention with myeloma cells and then screening the hybridomas resulting from the fusion for hybridoma clones that secrete an antibody able to bind a polypeptide of the invention. Briefly, mice can be immunized with an IL-17 antigen. In a preferred embodiment, the IL-17 antigen is administered with an adjuvant to stimulate the immune response. Such adjuvants include complete or incomplete Freund's adjuvant, RIBI (muramyl dipeptides) or ISCOM (immunostimulating complexes). Such adjuvants may protect the polypeptide from rapid dispersal by sequestering it in a local deposit, or they may contain substances that stimulate the host to secrete factors that are chemotactic for macrophages and other components of the immune system. Preferably, if a polypeptide is being administered, the immunization schedule will involve two or more administrations of the polypeptide, spread out over several weeks.

After immunization of an animal with an IL-17 antigen, antibodies and/or antibody-producing cells may be obtained from the animal. An anti-IL-17 antibody-containing serum is obtained from the animal by bleeding or sacrificing the animal. The serum may be used as it is obtained from the animal, an immunoglobulin fraction may be obtained from the serum, or the anti-IL-17 antibodies may be purified from the serum. Serum or immunoglobulins obtained in this manner are polyclonal, thus having a heterogeneous array of properties.

Once an immune response is detected, e.g., antibodies specific for the antigen IL-17 are detected in the mouse serum, the mouse spleen is harvested and splenocytes isolated. The splenocytes are then fused by well-known techniques to any suitable myeloma cells, for example cells from cell line SP20 available from the American Type Culture Collection (ATCC, Manassas, Va., US). Hybridomas are selected and cloned by limited dilution. The hybridoma clones are then assayed by methods known in the art for cells that secrete antibodies capable of binding IL-17. Ascites fluid, which generally contains high levels of antibodies, can be generated by immunizing mice with positive hybridoma clones.

In another embodiment, antibody-producing immortalized hybridomas may be prepared from the immunized animal. After immunization, the animal is sacrificed and the splenic B cells are fused to immortalized myeloma cells as is well known in the art. See, e.g., Harlow and Lane, supra. In a preferred embodiment, the myeloma cells do not secrete immunoglobulin polypeptides (a non-secretory cell line). After fusion and antibiotic selection, the hybridomas are screened using IL-17, or a portion thereof, or a cell expressing IL-17. In a preferred embodiment, the initial screening is performed using an enzyme-linked immunoassay (ELISA) or a radioimmunoassay (RIA), preferably an ELISA. An example of ELISA screening is provided in PCT Publication No. WO 00/37504, herein incorporated by reference.

Anti-IL-17 antibody-producing hybridomas are selected, cloned, and further screened for desirable characteristics, including robust hybridoma growth, high antibody production and desirable antibody characteristics, as discussed further below. Hybridomas may be cultured and expanded in vivo in syngeneic animals, in animals that lack an immune system, e.g., nude mice, or in cell culture in vitro. Methods of selecting, cloning and expanding hybridomas are well known to those of ordinary skill in the art.

In a preferred embodiment, the hybridomas are mouse hybridomas, as described above. In another preferred embodiment, the hybridomas are produced in a non-human, non-mouse species such as rats, sheep, pigs, goats, cattle or horses. In another embodiment, the hybridomas are human hybridomas, in which a human non-secretory myeloma is fused with a human cell expressing an anti-IL-17 antibody.

Antibody fragments that recognize specific epitopes may be generated by known techniques. For example, Fab and F(ab')2 fragments of the invention may be produced by proteolytic cleavage of immunoglobulin molecules, using enzymes such as papain (to produce Fab fragments) or pepsin (to produce F(ab')2 fragments). F(ab')2 fragments contain the variable region, the light chain constant region and the CH1 domain of the heavy chain.

2. Anti-IL-17 Monoclonal Antibodies Using SLAM

In another aspect of the invention, recombinant antibodies are generated from single, isolated lymphocytes using a procedure referred to in the art as the selected lymphocyte antibody method (SLAM), as described in U.S. Pat. No. 5,627,052; PCT Publication No. WO 92/02551; and Babcook et al., *Proc. Natl. Acad. Sci. USA*, 93: 7843-7848 (1996). In this method, single cells secreting antibodies of interest, e.g., lymphocytes derived from any one of the immunized animals described in Section 1, are screened using an antigen-specific hemolytic plaque assay, wherein the antigen IL-17, a subunit of IL-17, or a fragment thereof, is coupled to sheep red blood cells using a linker, such as biotin, and used to identify single cells that secrete antibodies with specificity for IL-17. Following identification of antibody-secreting cells of interest, heavy and light chain variable region (VH and VL) cDNAs are rescued from the cells by reverse transcriptase-PCR, and these variable regions can then be expressed, in the context of appropriate immunoglobulin constant regions (e.g., human constant regions), in mammalian host cells, such as COS or CHO cells. The host cells transfected with the amplified immunoglobulin sequences, derived from in vivo selected lymphocytes, can then undergo further analysis and selection in vitro, for example, by panning the transfected cells to isolate cells expressing antibodies to IL-17. The amplified immunoglobulin sequences further can be manipulated in vitro, such as by in vitro affinity maturation methods such as those described in PCT Publication No. WO 97/29131 and PCT Publication No. WO 00/56772.

3. Anti-IL-17 Monoclonal Antibodies Using Transgenic Animals

In another embodiment of the invention, antibodies are produced by immunizing a non-human animal comprising some, or all, of the human immunoglobulin locus with an IL-17 antigen. In a preferred embodiment, the non-human animal is a XENOMOUSE transgenic mouse, an engineered mouse strain that comprises large fragments of the human immunoglobulin loci and is deficient in mouse antibody production. See, e.g., Green et al., *Nature Genetics*, 7: 13-21 (1994) and U.S. Pat. Nos. 5,916,771; 5,939,598; 5,985,615; 5,998,209; 6,075,181; 6,091,001; 6,114,598 and 6,130,364. See also PCT Publication Nos. WO 91/10741, published Jul. 25, 1991; WO 94/02602, published Feb. 3, 1994; WO 96/34096 and WO 96/33735, both published Oct. 31, 1996; WO 98/16654, published Apr. 23, 1998; WO 98/24893, published Jun. 11, 1998; WO 98/50433, published Nov. 12, 1998; WO 99/45031, published Sep. 10, 1999; WO 99/53049, published Oct. 21, 1999; WO 00/09560, published Feb. 24, 2000; and WO 00/037504, published Jun. 29, 2000. The XENOMOUSE® transgenic mouse produces an adult-like human repertoire of fully human antibodies, and generates antigen-specific human Mabs. The XENOMOUSE® transgenic mouse contains approximately 80% of the human antibody repertoire through introduction of megabase sized, germline configuration YAC fragments of the human heavy chain loci and x light chain loci. See, Mendez et al., *Nature Genetics*, 15:146-156 (1997); and Green and Jakobovits, *J. Exp. Med.*, 188: 483-495 (1998), the disclosures of which are hereby incorporated by reference.

4. Anti IL-17 Monoclonal Antibodies Using Recombinant Antibody Libraries

In vitro methods also can be used to make the antibodies of the invention, wherein an antibody library is screened to identify an antibody having the desired binding specificity. Methods for such screening of recombinant antibody libraries are well known in the art and include methods described in, for example, Ladner et al., U.S. Pat. No. 5,223,409; Kang et al., PCT Publication No. WO 92/18619; Dower et al., PCT Publication No. WO 91/17271; Winter et al., PCT Publication No. WO 92/20791; Markland et al., PCT Publication No. WO 92/15679; Breitling et al., PCT Publication No. WO 93/01288; McCafferty et al., PCT Publication No. WO 92/01047; Garrard et al., PCT Publication No. WO 92/09690; Fuchs et al., *Bio/Technology*, 9: 1369-1372 (1991); Hay et al., *Hum. Antibod. Hybridomas*, 3: 81-85 (1992); Huse et al., *Science*, 246: 1275-1281 (1989); McCafferty et al., *Nature*, 348: 552-554 (1990); Griffiths et al., *EMBO J.*, 12: 725-734 (1993); Hawkins et al., *J. Mol. Biol.*, 226: 889-896 (1992); Clackson et al., *Nature*, 352: 624-628 (1991); Gram et al., *Proc. Natl. Acad. Sci. USA*, 89: 3576-3580 (1992); Garrard et al., *Bio/Technology*, 9: 1373-1377 (1991); Hoogenboom et al., *Nucl. Acid Res.*, 19: 4133-4137 (1991); and Barbas et al., *Proc. Natl. Acad. Sci. USA*, 88: 7978-7982 (1991); US patent application publication No. 2003/0186374; and PCT Publication No. WO 97/29131, the contents of each of which are incorporated herein by reference.

The recombinant antibody library may be from a subject immunized with IL-17A or IL-17F, or a portion of IL-17A or IL-17F. Alternatively, the recombinant antibody library may be from a naïve subject, i.e., one who has not been immunized with IL-17A or IL-17F, such as a human antibody library from a human subject who has not been immunized with human IL-17A or IL-17F. Antibodies of the invention are selected by screening the recombinant antibody library with the peptide comprising human IL-17 to thereby select those antibodies that recognize IL-17. Methods for conducting such screening and selection are well known in the art, such as described in the references in the preceding paragraph. To select antibodies of the invention having particular binding affinities for hIL-17, such as those that dissociate from human IL-17 with a particular $K_{off}$ rate constant, the art-known method of surface plasmon resonance can be used to select antibodies having the desired $K_{off}$ rate constant. To select antibodies of the invention having a particular neutralizing activity for hIL-17, such as those with a particular an $IC_{50}$, standard methods known in the art for assessing the inhibition of hIL-17 activity may be used.

In one aspect, the invention pertains to an isolated antibody, or an antigen-binding portion thereof, that binds human IL-17A and/or human IL-17. Preferably, the antibody is a neutralizing antibody. In various embodiments, the antibody is a recombinant antibody or a monoclonal antibody.

For example, the antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv, or disulfide stabilized Fv antibody domains recombinantly fused to either the phage gene III or gene VIII protein. Examples of phage display methods that can be used to make the antibodies of the present invention include those disclosed in Brinkmann et al., *J. Immunol. Methods*, 182: 41-50 (1995); Ames et al., *J. Immunol. Methods*, 184: 177-186 (1995); Kettleborough et al., *Eur. J. Immunol.*, 24: 952-958 (1994); Persic et al., *Gene*, 187: 9-18 (1994); Burton et al., *Advances in Immunology*, 57:191-280 (1994); PCT Publications Nos. WO 90/02809; WO 91/10737; WO 92/01047 (PCT/GB91/01134); WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

As described in the above references, after phage selection, the antibody coding regions from the phage can be isolated and used to generate whole antibodies including human antibodies or any other desired antigen binding fragment, and expressed in any desired host, including mammalian cells, insect cells, plant cells, yeast, and bacteria, e.g., as described in detail below. For example, techniques to recombinantly produce Fab, Fab' and F(ab')2 fragments can also be employed using methods known in the art such as those disclosed in PCT publication WO 92/22324; Mullinax et al., *BioTechniques*, 12(6): 864-869 (1992); and Sawai et al., *Am. J. Reprod. Immunol.*, 34: 26-34 (1995); and Better et al., *Science*, 240: 1041-1043 (1988), (said references incorporated by reference in their entireties). Examples of techniques which can be used to produce single-chain Fvs and antibodies include those described in U.S. Pat. Nos. 4,946,778 and 5,258,498; Huston et al., *Methods in Enzymology*, 203: 46-88 (1991); Shu et al., *Proc. Natl. Acad. Sci. USA*, 90: 7995-7999 (1993); and Skerra et al., *Science*, 240: 1038-1041 (1988).

Alternative to screening of recombinant antibody libraries by phage display, other methodologies known in the art for screening large combinatorial libraries can be applied to the identification of dual specificity antibodies of the invention. One type of alternative expression system is one in which the recombinant antibody library is expressed as RNA-protein fusions, as described in PCT Publication No. WO 98/31700 by Szostak and Roberts, and in Roberts, R. W. and Szostak, J. W. (1997) *Proc. Natl. Acad. Sci. USA*, 94: 12297-12302. In this system, a covalent fusion is created between an mRNA and the peptide or protein that it encodes by in vitro translation of synthetic mRNAs that carry puromycin, a peptidyl acceptor antibiotic, at their 3' end. Thus, a specific mRNA can be enriched from a complex mixture of mRNAs (e.g., a combinatorial library) based on the properties of the encoded peptide or protein, e.g., antibody, or portion thereof, such as binding of the antibody, or portion thereof, to the dual specificity antigen. Nucleic acid sequences encoding antibodies, or portions thereof, recovered from screening of such libraries can be expressed by recombinant means as described above (e.g., in mammalian host cells) and, moreover, can be subjected to further affinity maturation by either additional rounds of screening of mRNA-peptide fusions in which mutations have been introduced into the originally selected sequence(s), or by other methods for affinity maturation in vitro of recombinant antibodies, as described above.

In another approach the antibodies of the present invention can also be generated using yeast display methods known in the art. In yeast display methods, genetic methods are used to tether antibody domains to the yeast cell wall and display them on the surface of yeast. In particular, such yeast can be utilized to display antigen-binding domains expressed from a repertoire or combinatorial antibody library (e.g., human or murine). Examples of yeast display methods that can be used to make the antibodies of the present invention include those disclosed Wittrup et al. in U.S. Pat. No. 6,699,658, incorporated herein by reference.

B. Production of Recombinant IL-17 Antibodies

Antibodies of the present invention may be produced by any of a number of techniques known in the art. For example, expression from host cells, wherein expression vector(s)

encoding the heavy and light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection, and the like. Although it is possible to express the antibodies of the invention in either prokaryotic or eukaryotic host cells, expression of antibodies in eukaryotic cells is preferable, and most preferable in mammalian host cells, because such eukaryotic cells (and in particular mammalian cells) are more likely than prokaryotic cells to assemble and secrete a properly folded and immunologically active antibody.

Preferred mammalian host cells for expressing the recombinant antibodies of the invention include Chinese Hamster Ovary (CHO cells) (including dhfr-CHO cells, described in Urlaub and Chasin, (1980) *Proc. Natl. Acad. Sci. USA,* 77: 4216-4220, used with a DHFR selectable marker, e.g., as described in R. J. Kaufman and P. A. Sharp (1982) *Mol. Biol.,* 159: 601-621), NS0 myeloma cells, COS cells and SP2 cells. When recombinant expression vectors encoding antibody genes are introduced into mammalian host cells, the antibodies are produced by culturing the host cells for a period of time sufficient to allow for expression of the antibody in the host cells or, more preferably, secretion of the antibody into the culture medium in which the host cells are grown. Antibodies can be recovered from the culture medium using standard protein purification methods.

Host cells can also be used to produce functional antibody fragments, such as Fab fragments or scFv molecules. It will be understood that variations on the above procedure are within the scope of the present invention. For example, it may be desirable to transfect a host cell with DNA encoding functional fragments of either the light chain and/or the heavy chain of an antibody of this invention. Recombinant DNA technology may also be used to remove some, or all, of the DNA encoding either or both of the light and heavy chains that is not necessary for binding to the antigens of interest. The molecules expressed from such truncated DNA molecules are also encompassed by the antibodies of the invention. In addition, bifunctional antibodies may be produced in which one heavy and one light chain are an antibody of the invention and the other heavy and light chain are specific for an antigen other than the antigens of interest by crosslinking an antibody of the invention to a second antibody by standard chemical crosslinking methods.

In a preferred system for recombinant expression of an antibody, or antigen-binding portion thereof, of the invention, a recombinant expression vector encoding both the antibody heavy chain and the antibody light chain is introduced into dhfr-CHO cells by calcium phosphate-mediated transfection. Within the recombinant expression vector, the antibody heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. Still further the invention provides a method of synthesizing a recombinant antibody of the invention by culturing a host cell of the invention in a suitable culture medium until a recombinant antibody of the invention is synthesized. The method can further comprise isolating the recombinant antibody from the culture medium.

1. Anti hIL-17 Antibodies

Table 5 is a list of amino acid sequences of VH and VL regions of preferred murine anti-hIL-17 antibodies of the invention.

TABLE 5

List of Amino Acid Sequences of Murine Anti-hIL-17 Antibody VH and VL Regions

| SEQ ID No. | Protein region | | Sequence 12345678901234567890123456789 0 |
|---|---|---|---|
| 26 | VH 7D7 | | QVQLQQSGAELVRPGTSVTLSCKASGYRFT DYEIHWIKQTPAQVLEWIGVTDPESGGTLH NPKFDGKATLTADKSSRTAYMELRSLTSED SAVYYCTRYYKYESFYGMDYWGQGTSVTVS S |
| | VH 7D7 CDR-H1 | Residues 31-35 of SEQ ID NO.: 26 | DYEIH |
| | VH 7D7 CDR-H2 | Residues 50-66 of SEQ ID NO.: 26 | VTDPESGGTLHNPKFDG |
| | VH 7D7 CDR-H3 | Residues 99-110 of SEQ ID NO.: 26 | YYKYESFYGMDY |
| 27 | VL 7D7 | | QIVLTQSPAIMSAFPGEKVTMTCSASSSIS YMCWYQQKPGTSPKRWICDTSKLASGVPVR FSGSGSGTSYSLTINSMETEDAATYYCQQR SSYPWTFGGGTKVEIKR |
| | VL 7D7 CDR-L1 | Residues 24-33 of SEQ ID NO.: 27 | SASSSISYMC |
| | VL 7D7 CDR-L2 | Residues 49-55 of SEQ ID NO.: 27 | DTSKLAS |

TABLE 5-continued

List of Amino Acid Sequences of Murine Anti-hIL-17 Antibody VH and VL Regions

| SEQ ID No. | Protein region | | Sequence 123456789012345678901234567890 |
|---|---|---|---|
| | VL 7D7 CDR-L3 | Residues 88-96 of SEQ ID NO.: 27 | QQRSSYPWT |
| 28 | VH 6C6 | | QVQLQQSGAELVRPGASVKLSCKASGYTFSDYEIHWVKQTPVHGLAWIGVIHPGNGGTAYNQKFKDKATLTADKSSSTAYMELSSLTSEDSAVYYCERFLTYEGYFDYWGQGTTLTVSS |
| | VH 6C6 CDR-H1 | Residues 31-35 of SEQ ID NO.: 28 | DYEIH |
| | VH 6C6 CDR-H2 | Residues 50-66 of SEQ ID NO.: 28 | VIHPGNGGTAYNQKFKD |
| | VH 6C6 CDR-H3 | Residues 99-108 of SEQ ID NO.: 28 | FLTYEGYFDY |
| 29 | VL 6C6 | | SIVMTQTPKFLLVSAGDRVTITCKASQSVNNDVAWYQHKPGQSPKLLINYASNRYTGVPDRFTGSGYGTDFTFTISTVQAEDLAIYFCQQDYGSPYTFGGGTKLEIKR |
| | VL 6C6 CDR-L1 | Residues 24-34 of SEQ ID NO.: 29 | KASQSVNNDVA |
| | VL 6C6 CDR-L2 | Residues 50-56 of SEQ ID NO.: 29 | YASNRYT |
| | VL 6C6 CDR-L3 | Residues 89-97 of SEQ ID NO.: 29 | QQDYGSPYT |
| 30 | VH 1D8 | | QVQLQQSGAELVRPGASVKLSCKASGYTFSDYEMHWVKQTPVHGLEWIGVIHPGNGGTAYNQKFRDKATLTADKSSTTAYMELSSLTSEDSAVYYCIRFLTYEGYFDYWGQGTTLTVSS |
| | VH 1D8 CDR-H1 | Residues 31-35 of SEQ ID NO.: 30 | DYEMH |
| | VH 1D8 CDR-H2 | Residues 50-66 of SEQ ID NO.: 30 | VIHPGNGGTAYNQKFRD |
| | VH 1D8 CDR-H3 | Residues 99-108 of SEQ ID NO.: 30 | FLTYEGYFDY |
| 31 | VL 1D8 | | SIVMTQTPKFLLVSAGDRVTITCKASQSVNNDVAWFQHKPGQSPKLLINYASNRYTGVPDRFTGSGYGTDFTFTISTVQSEDLAIYFCQQDYGSPYTFGGGTTLEIKR |
| | VL 1D8 CDR-L1 | Residues 24-34 of SEQ ID NO.: 31 | KASQSVNNDVA |
| | VL 1D8 CDR-L2 | Residues 50-56 of SEQ ID NO.: 31 | YASNRYT |
| | VL 1D8 CDR-L3 | Residues 89-97 of SEQ ID NO.: 31 | QQDYGSPYT |
| 32 | VH 8B12 | | QVQLKESGPGLVAPSQSLSITCTISGFSLTSYGVHWVRQPPGKGLEWLVVIWSDGTTTYNSALKSRLSITRDNSKSQVFLKMNSLQTDDTAIYYCARDSTWDYYYTMDYWGQGTPVTVSS |
| | VH 8B12 CDR-H1 | Residues 31-35 of SEQ ID NO.: 32 | SYGVH |
| | VH 8B12 CDR-H2 | Residues 50-65 of SEQ ID NO.: 32 | VIWSDGTTTYNSALKS |
| | VH 8B12 CDR-H3 | Residues 98-109 of SEQ ID NO.: 32 | DSTWDYYYTMDY |

TABLE 5-continued

List of Amino Acid Sequences of Murine Anti-hIL-17 Antibody VH and VL Regions

| SEQ ID No. | Protein region | | Sequence 123456789012345678901234567890 |
|---|---|---|---|
| 33 | VL 8B12 | | DVVMTQTPLSLPVSLGDQASISCRSSQSLV HSNGNTYLHWYLQKPGQSPKLLIYKVSNRF SGVPDRFSGSGSGTDFTLKISRVEAEDLGV YFCSQSTHVYTFGGGTKLEIKR |
| | VL 8B12 CDR-L1 | Residues 24-39 of SEQ ID NO.: 33 | RSSQSLVHSNGNTYLH |
| | VL 8B12 CDR-L2 | Residues 55-61 of SEQ ID NO.: 33 | KVSNRFS |
| | VL 8B12 CDR-L3 | Residues 94-101 of SEQ ID NO.: 33 | SQSTHVYT |
| 34 | VH 10F7 | | QVQLQQSGAELVRPGTSVTLSCKASGYIFT DYEIHWVKQTPVHGLEWIGVNDPESGGTFY NQKFDGKAELTADKSSTAYMELRSLTSED SGVYYCTRYYRYESFYGMDYWGQGTSITVS S |
| | VH 10F7 CDR-H1 | Residues 31-35 of SEQ ID NO.: 34 | DYEIH |
| | VH 10F7 CDR-H2 | Residues 50-66 of SEQ ID NO.: 34 | VNDPESGGTFYNQKFDG |
| | VH 10F7 CDR-H3 | Residues 99-110 of SEQ ID NO.: 34 | YYRYESFYGMDY |
| 35 | VL 10F7 | | QIVLTQSPAIMSASPGEKVTMTCSASSSIS YIYWFQQKPGTSPKRWIYATFELASGVPAR FSGSGSGTSYSLTISSMEAEDAATYYCHQR SSYPWTFGGGSKLEIKR |
| | VL 10F7 CDR-L1 | Residues 24-33 of SEQ ID NO.: 35 | SASSSISYIY |
| | VL 10F7 CDR-L2 | Residues 49-55 of SEQ ID NO.: 35 | ATFELAS |
| | VL 10F7 CDR-L3 | Residues 88-96 of SEQ ID NO.: 35 | HQRSSYPWT |
| 36 | VH 5C5 | | QVQLQQSGAELVRPGASVKLASCKALGYTFT DYEFHWVKQTPVHGLEWIGVIHPGNGGTAY NQNFRDKATLTADKSSTAYMELSSLTSED SGVYYCTRFLTYEGYFDYWGQGTALTVSS |
| | VH 5C5 CDR-H1 | Residues 31-35 of SEQ ID NO.: 36 | DYEFH |
| | VH 5C5 CDR-H2 | Residues 50-66 of SEQ ID NO.: 36 | VIHPGNGGTAYNQNFRD |
| | VH 5C5 CDR-H3 | Residues 99-108 of SEQ ID NO.: 36 | FLTYEGYFDY |
| 37 | VL 5C5 | | NIVMTQTPKFLLVSPGDRVTITCKASQSVS IDVGWFQQKPGQSPKLLIYHASNRYTGVPD RFTGSGYGTDFTFTVNTVQAEDLAVYFCQQ DYSSPYTFGGGTKLELKR |
| | VL 5C5 CDR-L1 | Residues 24-34 of SEQ ID NO.: 37 | KASQSVSIDVG |
| | VL 5C5 CDR-L2 | Residues 50-56 of SEQ ID NO.: 37 | HASNRYT |
| | VL 5C5 CDR-L3 | Residues 89-97 of SEQ ID NO.: 37 | QQDYSSPYT |

TABLE 5-continued

List of Amino Acid Sequences of Murine Anti-hIL-17 Antibody VH and VL Regions

| SEQ ID No. | Protein region | | Sequence 12345678901234567890123456789 0 |
|---|---|---|---|
| 38 | VH 10G9 | | QVQLKESGPALVAPSQSLSFTCTISGFSLS SYGVHWVRQPPGKGLEWLVVIWSDGTTTYN SALKSRLSISKDNSKSQVFLKMNSLQTDDT AMYYCARDGYYIYTMDYWGQGTSVTVSS |
| | VH 10G9 CDR-H1 | Residues 31-35 of SEQ ID NO.: 38 | SYGVH |
| | VH 10G9 CDR-H2 | Residues 50-65 of SEQ ID NO.: 38 | VIWSDGTTTYNSALKS |
| | VH 10G9 CDR-H3 | Residues 98-107 of SEQ ID No.: 38 | DGYYIYTMDY |
| 39 | VL 10G9 | | DVVMTQTPLSLPVSLGDQASISCRSSQSLV HSNGNTYLHWYLQRPGQSPKLLIYKVSNRF SGVPDRFSGSGSGTDFTLKISRVEAEDLGL YFCSQGTHAPLTFGAGTKLELNR |
| | VL 10G9 CDR-L1 | Residues 24-39 of SEQ ID NO.: 39 | RSSQSLVHSNGNTYLH |
| | VL 10G9 CDR-L2 | Residues 55-61 of SEQ ID NO.: 39 | KVSNRFS |
| | VL 10G9 CDR-L3 | Residues 94-102 of SEQ ID NO.: 39 | SQGTHAPLT |

Based on an alignment of the amino acid sequences of the CDRs of the VH and VL regions of the murine anti-hIL-17 antibodies listed in Table 5, above, the invention provides an IL-17 binding protein comprising an antigen binding domain capable of binding human IL-17, said antigen binding domain comprising at least one CDR comprising an amino acid sequence selected from the group consisting of:

CDR-H1. $X_1$-$X_2$-$X_3$-$X_4$-$X_5$ (SEQ ID NO:919), wherein;
  $X_1$ is D or S;
  $X_2$ is Y;
  $X_3$ is E or G;
  $X_4$ is I, M, V, or F;
  $X_5$ is H;
CDR-H2. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$ (SEQ ID NO:920), wherein;
  $X_1$ is V;
  $X_2$ is T, I, or N;
  $X_3$ is D, H, or W;
  $X_4$ is P or is not present;
  $X_5$ is E, G, or S;
  $X_6$ is S, N, or D;
  $X_7$ is G;
  $X_8$ is G or T;
  $X_9$ is T;
  $X_{10}$ is L, A, T, or F;
  $X_{11}$ is H or Y;
  $X_{12}$ is N;
  $X_{13}$ is P, Q, or S;
  $X_{14}$ is K, A, or N;
  $X_{15}$ is F or L;
  $X_{16}$ is D, K, or R; and
  $X_{17}$ is G, D, or S;
CDR-H3. $X_1$-$X_2$-$X_3$-$X_4$-$X_5$-$X_6$-$X_7$-$X_8$-$X_9$-$X_{10}$-$X_{11}$-$X_{12}$ (SEQ ID NO:921), wherein;
  $X_1$ is Y, F, or D;
  $X_2$ is Y, L, S, or G;
  $X_3$ is K, T, R, or Y;
  $X_4$ is Y or W;
  $X_5$ is E, D, or I;
  $X_6$ is S, G, or Y;
  $X_7$ is F, Y, or T;
  $X_8$ is Y, F, or M;
  $X_9$ is G, T, or is not present;
  $X_{10}$ is M or is not present;
  $X_{11}$ is D; and
  $X_{12}$ is Y;
CDR-L1. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$ (SEQ ID NO:922), wherein;
  $X_1$ is S, K, or R;
  $X_2$ is A or S;
  $X_3$ is S;
  $X_4$ is S or Q;
  $X_5$ is S or is not present;
  $X_6$ is L or is not present;
  $X_7$ is V or is not present;
  $X_8$ is H or is not present;
  $X_9$ is S or is not present;
  $X_{10}$ is S, N, or is not present;
  $X_{11}$ is S, V, or G;
  $X_{12}$ is I, N, or S;
  $X_{13}$ is S, N, T, or I;
  $X_{14}$ is Y or D;
  $X_{15}$ is M, V, L, or I; and
  $X_{16}$ is C, A, H, Y, or G;
CDR-L2. $X_1$-$X_2$-$X_3$-$X_4$-$X_5$-$X_6$-$X_7$ (SEQ ID NO:923), wherein;
  $X_1$ is D, Y, K, A, or H;
  $X_2$ is T, A, or V;
  $X_3$ is S or F;
  $X_4$ is K, N, or E;

$X_5$ is L or R;
$X_6$ is A, Y, or F; and
$X_7$ is S or T;
and
CDR-L3. $X_1$-$X_2$-$X_3$-$X_4$-$X_5$-$X_6$-$X_7$-$X_8$-$X_9$ (SEQ ID NO:924), wherein;
$X_1$ is Q, S, or H;
$X_2$ is Q;
$X_3$ is R, D, S, or G;
$X_4$ is S, Y, or T;
$X_5$ is S, G, or H;
$X_6$ is Y, S, V, or A;
$X_7$ is P or is not present;
$X_8$ is W, Y, or L; and
$X_9$ is T.

Table 6 provides a list of amino acid sequences of VH and VL regions of preferred human anti-hIL-17 antibodies of the invention.

TABLE 6

List of Amino Acid Sequences of Human Anti-hIL-17 Antibody VH and VL Regions

| SEQ ID No. | Protein region | | Sequence 12345678901234567890123456789 0 |
|---|---|---|---|
| 40 | VH IL17-TN-L7-G9 | | EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| | VH G9 CDR-H1 | Residues 31-35 of SEQ ID NO.: 40 | NYGMH |
| | VH G9 CDR-H2 | Residues 50-66 of SEQ ID NO.: 40 | VISYDGSNKYYADSVKG |
| | VH G9 CDR-H3 | Residues 99-103 of SEQ ID NO.: 40 | VGASGDYYYSYGLDV |
| 41 | VL IL17-TN-L7-G9 | | QSGLTQPPSASGTPGQTVSISCSGSNSNIG SHSVNWYQQVPGAAPKLLMYGIGQRPSGVP DRFSVSQSGTSASLAISGLQSEDEADYYCA TWDDSLGGYVFGSGTKVTVLG |
| | VL G9 CDR-L1 | Residues 23-35 of SEQ ID NO.: 41 | SGSNSNIGSHSVN |
| | VL G9 CDR-L2 | Residues 51-57 of SEQ ID NO.: 41 | GIGQRPS |
| | VL G9 CDR-L3 | Residues 90-110 of SEQ ID NO.: 41 | ATWDDSLGGYV |
| 42 | VH IL17-TN-L7-A7 | | EVQLLESGGGVVQPGTFLRLSCAATGFTFS AYGMHWVRQAPGRGLEWVAVTSYDGSNKYY ADSVKGRFTISRDNSKNTLYLEMNSLRPED TAVYYCAKVGASGDYYYSYGLDVWGQGTMV TVSS |
| | VH A7 CDR-H1 | Residues 31-35 of SEQ ID NO.: 42 | AYGMH |
| | VH A7 CDR-H2 | Residues 50-66 of SEQ ID NO.: 42 | VTSYDGSNKYYADSVKG |
| | VH A7 CDR-H3 | Residues 99-103 of SEQ ID NO.: 42 | VGASGDYYYSYGLDV |
| 43 | VL IL17-TN-L7-A7 | | QSGLTQPPSASGTPGQTVSISCSGSNSNIG SHSVNWYQQVPGAAPKLLMYGIGQRPSGVP DRFSVSQSGTSASLAISGLQSEDEADYYCA TWDDSLGGYVFGSGTKVTVLG |
| | VL A7 CDR-L1 | Residues 23-35 of SEQ ID NO.: 43 | SGSNSNIGSHSVN |
| | VL A7 CDR-L2 | Residues 51-57 of SEQ ID NO.: 43 | GIGQRPS |
| | VL A7 CDR-L3 | Residues 90-110 of SEQ ID NO.: 43 | ATWDDSLGGYV |
| 44 | VH IL17-TN-L7-C8 | | EVQLVQSGAEVKKPGASVKVSCKASGYTFS DFDIDWVRQATGLGLEWMGWMNPNSGNTGV APKFRGRVSMTFNTAIRTAYLELSSLRPDD |

TABLE 6-continued

List of Amino Acid Sequences of Human Anti-hIL-17 Antibody VH and VL Regions

| SEQ ID No. | Protein region | | Sequence 12345678901234567890123456 7890 |
|---|---|---|---|
| | | | TAVYFCARSSESEGITIGFDNWGQGTLVTV SS |
| | VH C8 CDR-H1 | Residues 31-35 of SEQ ID NO.: 44 | DFDID |
| | VH C8 CDR-H2 | Residues 50-66 of SEQ ID NO.: 44 | WMNPNSGNTGVAPKFRG |
| | VH C8 CDR-H3 | Residues 99-101 of SEQ ID NO.: 44 | SSESEGITIGFDN |
| 45 | VL IL17-TN-L7-C8 | | SYELTQPPSVSVSPGQTASIPCSGDKLGNR YACWYKQKPGQPPVLVIYQDNKRPSGISER YSGSNYGDTATLTITGTQAMDEADYYCQTW DSTTGSYVFGTGTKVTVLG |
| | VL C8 CDR-L1 | Residues 23-35 of SEQ ID NO.: 45 | SGDKLGNRYAC |
| | VL C8 CDR-L2 | Residues 51-57 of SEQ ID NO.: 45 | QDNKRPS |
| | VL C8 CDR-L3 | Residues 90-110 of SEQ ID NO.: 45 | QTWDSTTGSYV |
| 46 | VH IL17-TN-K7-B6 | | EVQLVQSGAEVKKPGESLKISCKASGGSFR SYGISWVRQAPGQGLEWMGGITPILGTANY AQKFQGRVTITADESTTTAYMELSGLTSDD TAVYYCAREPNDFWNGYYTTHHFDYWGQGT PVTVSS |
| | VH B6 CDR-H1 | Residues 31-35 of SEQ ID NO.: 46 | SYGIS |
| | VH B6 CDR-H2 | Residues 50-66 of SEQ ID NO.: 46 | GITPILGTANYAQKFQG |
| | VH B6 CDR-H3 | Residues 99-115 of SEQ ID NO.: 46 | EPNDFWNGYYTTHHFDY |
| 47 | VL IL17-TN-K7-B6 | | DVVMTQSPDFQSVTPKEKVTITCRASQNIG SALHWYQQKPDQSPKLLIKYASQSISGVPS RFSGSGSGTDFTLTINGLEAEDAGTYYCHQ STSLPHTFGQGTKLDIKR |
| | VL B6 CDR-L1 | Residues 24-34 of SEQ ID NO.: 47 | RASQNIGSALH |
| | VL B6 CDR-L2 | Residues 50-56 of SEQ ID NO.: 47 | YASQSIS |
| | VL B6 CDR-L3 | Residues 89-97 of SEQ ID NO.: 47 | HQSTSLPHT |
| 48 | VH IL17-LN-K9-F5 | | EVQLVQSGAEVKNPGASVKVSCKVSGSRLS DLAMHWVRQAPGKGPEWMGGFDPDEGETVY AQNFQGRVSMTEDTSSDTAYMELNSLRSED TAVYYCATIRPWLGGAYYFDNWGQGTLVTV SS |
| | VH F5 CDR-H1 | Residues 31-35 of SEQ ID NO.: 48 | DLAMH |
| | VH F5 CDR-H2 | Residues 50-66 of SEQ ID NO.: 48 | GFDPDEGETVYAQNFQG |
| | VH F5 CDR-H3 | Residues 99-101 of SEQ ID NO.: 48 | IRPWLGGAYYFDN |
| 49 | VL IL17-LN-K9-F5 | | ETTLTQSPAFMSATPGDKVNISCKASQDID DDMNWYQQKPGEAALFIIQEATTLVPGIPP RFSGSGYGTDFTLTVNNIQSEDAAYYFCLQ HDSFPYTFGQGTKLEIKR |

TABLE 6-continued

List of Amino Acid Sequences of Human Anti-hIL-17
Antibody VH and VL Regions

| SEQ ID No. | Protein region | | Sequence 12345678901234567890123456789012345678890 |
|---|---|---|---|
| | VL F5 CDR-L1 | Residues 24-34 of SEQ ID NO.: 49 | KASQDIDDDMN |
| | VL F5 CDR-L2 | Residues 50-56 of SEQ ID NO.: 49 | EATTLVP |
| | VL F5 CDR-L3 | Residues 89-97 of SEQ ID NO.: 49 | LQHDSFPYT |

Based on an alignment of the amino acid sequences of the CDRs of the VH and VL regions of the human anti-hIL-17 antibodies listed in Table 6, above, the invention provides an IL-17 binding protein comprising an antigen binding domain capable of binding human IL-17, said antigen binding domain comprising at least one CDR comprising an amino acid sequence selected from the group consisting of:

CDR-H1. $X_1$-$X_2$-$X_3$-$X_4$-$X_5$ (SEQ ID NO:925), wherein;
  $X_1$ is N, A, D, or S;
  $X_2$ is Y, F, or L;
  $X_3$ is G, D, or A;
  $X_4$ is M or I; and
  $X_5$ is H, D, or S;

CDR-H2. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$ (SEQ ID NO:926), wherein;
  $X_1$ is V, W, or G;
  $X_2$ is I, T, M, or F;
  $X_3$ is S, N, T, or D;
  $X_4$ is Y or P;
  $X_5$ is D, N, or I;
  $X_6$ is G, S, L, or E;
  $X_7$ is S or G;
  $X_8$ is N, T, or E;
  $X_9$ is K, T, or A;
  $X_{10}$ is Y, G, N, or V;
  $X_{11}$ is Y or V;
  $X_{12}$ is A;
  $X_{13}$ is D, P, or Q;
  $X_{14}$ is S, K, or N;
  $X_{15}$ is V or F;
  $X_{16}$ is K, R, or Q; and
  $X_{17}$ is G;

CDR-H3. $X_1$-$X_2$-$X_3$-$X_4$-$X_5$-$X_6$-$X_7$-$X_8$-$X_9$-$X_{10}$-$X_{11}$-$X_{12}$-$X_{13}$-$X_{14}$-$X_{15}$-$X_{16}$-$X_{17}$ (SEQ ID NO:927), wherein;
  $X_1$ is V, S, E, or I;
  $X_2$ is G, S, P, or R;
  $X_3$ is A, E, N, or P;
  $X_4$ is S, D, or W;
  $X_5$ is G, E, F, or L;
  $X_6$ is D, G, or W;
  $X_7$ is Y, I, N, or G;
  $X_8$ is Y, T, G, or A;
  $X_9$ is Y or I;
  $X_{10}$ is S, G, or Y;
  $X_{11}$ is Y, F, or T;
  $X_{12}$ is G, T, or is not present;
  $X_{13}$ is L, H, or is not present;
  $X_{14}$ is H or is not present;
  $X_{15}$ is F or is not present;
  $X_{16}$ is D; and
  $X_{17}$ is V, N, or Y;

CDR-L1. $X_1$-$X_2$-$X_3$-$X_4$-$X_5$-$X_6$-$X_7$-$X_8$-$X_9$-$X_{10}$-$X_{11}$-$X_{12}$-$X_{13}$ (SEQ ID NO:928), wherein;
  $X_1$ is S, R, or K;
  $X_2$ is G or A;
  $X_3$ is S or D;
  $X_4$ is N, K, or Q;
  $X_5$ is S or is not present;
  $X_6$ is N or is not present;
  $X_7$ is I, L, N, or D;
  $X_8$ is G or I;
  $X_9$ is S, N, G, or D;
  $X_{10}$ is H, R, S, or D;
  $X_{11}$ is S, Y, A, or D;
  $X_{12}$ is V, A, L, or M; and
  $X_{13}$ is N, C, or H;

CDR-L2. $X_1$-$X_2$-$X_3$-$X_4$-$X_5$-$X_6$-$X_7$ (SEQ ID NO:929), wherein;
  $X_1$ is G, Q, Y, or E;
  $X_2$ is I, D, or A;
  $X_3$ is G, N, S, or T;
  $X_4$ is Q, K, or T;
  $X_5$ is R, S, or L;
  $X_6$ is P, I, or V; and
  $X_7$ is S or P;

and

CDR-L3. $X_1$-$X_2$-$X_3$-$X_4$-$X_5$-$X_6$-$X_7$-$X_8$-$X_9$-$X_{10}$-$X_{11}$ (SEQ ID NO:930), wherein;
  $X_1$ is A, Q, H, or L;
  $X_2$ is T or Q;
  $X_3$ is W, S, or H;
  $X_4$ is D or T;
  $X_5$ is D or S;
  $X_6$ is S, T, L, or F;
  $X_7$ is L, T, or P;
  $X_8$ is G, H, or Y;
  $X_9$ is G, S, or T;
  $X_{10}$ is Y or is not present; and
  $X_{11}$ is V or is not present;

2. Anti hIL-17 Chimeric Antibodies

A chimeric antibody is a molecule in which different portions of the antibody are derived from different animal species, such as antibodies having a variable region derived from a murine monoclonal antibody and a human immunoglobulin constant region. Methods for producing chimeric antibodies are known in the art and discussed in detail in the Examples section. See, e.g., Morrison, *Science,* 229: 1202-1207 (1985); Oi et al., *BioTechniques,* 4: 214-221 (1986); Gillies et al., *J. Immunol. Methods,* 125: 191-202 (1989); U.S. Pat. Nos. 5,807,715; 4,816,567; and 4,816,397, which are incorporated herein by reference in their entireties. In addition, techniques developed for the production of "chimeric antibodies" (Morrison et al., *Proc. Natl. Acad. Sci. USA*, 81: 6851-6855 (1984); Neuberger et al., *Nature*, 312: 604-608 (1984); Takeda et al., *Nature*, 314: 452-454 (1985), which are incorporated herein by reference in their entireties) by splicing genes from a mouse antibody molecule of appropriate antigen specificity together with genes from a human antibody molecule of appropriate biological activity can be used.

In one embodiment, the chimeric antibodies of the invention are produced by replacing the heavy chain constant region of the murine monoclonal anti human IL-17 antibodies described in section 1 with a human IgG1 constant region.

3. Anti IL-17 CDR-Grafted Antibodies

CDR-grafted antibodies of the invention comprise heavy and light chain variable region sequences from a human antibody wherein one or more of the CDR regions of V$_H$ and/or V$_L$ are replaced with CDR sequences of the murine antibodies of the invention. A framework sequence from any human antibody may serve as the template for CDR grafting. However, straight chain replacement onto such a framework often leads to some loss of binding affinity to the antigen. The more homologous a human antibody is to the original murine antibody, the less likely the possibility that combining the murine CDRs with the human framework will introduce distortions in the CDRs that could reduce affinity. Therefore, it is preferable that the human variable framework that is chosen to replace the murine variable framework apart from the CDRs have at least a 65% sequence identity with the murine antibody variable region framework. It is more preferable that the human and murine variable regions apart from the CDRs have at least 70% sequence identify. It is even more preferable that the human and murine variable regions apart from the CDRs have at least 75% sequence identity. It is most preferable that the human and murine variable regions apart from the CDRs have at least 80% sequence identity. Methods for producing chimeric antibodies are known in the art and discussed in detail in Example 2.2. (also see EP 0 239 400; PCT Publication No. WO 91/09967; U.S. Pat. Nos. 5,225,539; 5,530,101; and 5,585,089); veneering or resurfacing (see, e.g., EP 0 592 106; EP 0 519 596; Padlan, *Molecular Immunology*, 28(4/5): 489-498 (1991); Studnicka et al., *Protein Engineering*, 7(6): 805-814 (1994); Roguska et al., *Proc. Natl. Acad. Sci. USA*, 91: 969-973 (1994)); and chain shuffling (see, e.g., U.S. Pat. No. 5,565,352).

In a specific embodiment the invention provides CDR grafted antibodies with V$_H$ and/or V$_L$ chains as described in Table 7.

TABLE 7

CDR Grafted Antibodies

| SEQ ID No. | Protein region | Sequence 12345678901234567890123456789 0 |
|---|---|---|
| 50 | h10F7VH.1z | QVQLVQSGAEVKKPGSSVKVSCKASGGTFSD YEIHWVRQAPGQGLEWMGVNDPESGGTFYNQ KFDGRVTITADKSTSTAYMELSSLRSEDTAV YYCARYYRYESFYGMDYWGQGTTVTVSS |
| 51 | h10F7Vk.1z | DIQMTQSPSSLSASVGDRVTITCSASSSISY IYWYQQKPGKAPKRLIYATFELASGVPSRFS GSGSGTEFTLTISSLQPEDFATYYCHQRSSY PWTFGGGTKLEIKR |
| 52 | h10F7Vk.2 | EIVLTQSPDFQSVTPKEKVTITCSASSSISY IYWYQQKPDQSPKLLIKATFELASGVPSRFS GSGSGTDFTLTINSLEAEDAATYYCHQRSSY PWTFGGGTKLEIKR |

TABLE 7-continued

CDR Grafted Antibodies

| SEQ ID No. | Protein region | Sequence 12345678901234567890123456789 0 |
|---|---|---|
| 53 | h10F7Vk.3z | DIQMTQSPSSLSASVGDRVTITCSASSSISY IYWYQQKPGKAPKRLIYATFELASGVPSRFS GSGSGTEFTLTISSLQPEDFATYYCHQRSSY PWTFGGGTKVEIKR |
| 54 | h10F7Vk.4 | EIVLTQSPDFQSVTPKEKVTITCSASSSISY IYWYQQKPDQSPKLLIKATFELASGVPSRFS GSGSGTDFTLTINSLEAEDAATYYCHQRSSY PWTFGGGTKVEIKR |
| 55 | h5C5VH.1z | QVQLVQSGAEVKKPGSSVKVSCKASGGTFSD YEFHWVRQAPGQGLEWMGVIHPGNGGTAYNQ NFRDRVTITADKSTSTAYMELSSLRSEDTAV YYCARFLTYEGYFDYWGQGTLVTVSS |
| 56 | h5C5Vk.1z | DIQMTQSPSSLSASVGDRVTITCKASQSVSI DVGWYQQKPGKAPKLLIYHASNRYTGVPSRF SGSGSGTDFTFTISSLQPEDIATYYCQQDYS SPYTFGQGTKLEIKR |
| 57 | h5C5Vk.2z | DIQMTQSPSSLSASVGDRVTITCKASQSVSI DVGWYQQKPGKAPKLLIYHASNRYTGVPSRF SGSGSGTDFTFTISSLQPEDIATYYCQQDYS SPYTFGGGTKVEIKR |
| 58 | h5C5Vk.3z | EIVMTQSPATLSVSPGERATLSCKASQSVSI DVGWYQQKPGQAPRLLIYHASNRYTGIPARF SGSGSGTEFTLTISSLQSEDFAVYYCQQDYS SPYTFGQGTKLEIKR |
| 59 | h5C5Vk.4z | EIVMTQSPATLSVSPGERATLSCKASQSVSI DVGWYQQKPGQAPRLLIYHASNRYTGIPARF SGSGSGTEFTLTISSLQSEDFAVYYCQQDYS SPYTFGGGTKVEIKR |

4. Anti-hIL-17 Humanized Antibodies

Humanized antibodies are antibody molecules derived from non-human species antibody that binds the desired antigen having one or more complementarity determining regions (CDRs) from the non-human species antibody and framework regions from a human immunoglobulin molecule. Known human Ig sequences are disclosed, e.g., at worldwide web sites: www.ncbi.nlm.nih.gov/entrez-/query.fcgi; www.atcc.org/phage/hdb.html; www.sciquest.com/; www.abcam.com/; www.antibodyresource.com/onlinecomp.html; www.public.iastate.edu/.about.pedro/research_ctools.html; www.mgen.uni-heidelberg.de/SD/IT/IT.html; www.whfreeman.com/immunology/CH-05/kuby05.htm; www.library.thinkquest.org/12429/Immune/Antibody.html; www.hhmi.org/grants/lectures/1996/vlab/; www.path.cam.ac.uk/.about.mrc7/m-ikeimages.html; www.antibodyresource.com/; mcb.harvard.edu/BioLinks/Immuno-logy.html.www.immunologylink.com/; pathbox.wustl.edu/.cccabout.hcenter/index.-html; www.biotech.ufl.edu/.ccabout.hcl/; www.pebio.com/pa/340913/340913.html-; www.nal.usda.gov/awic/pubs/antibody/; www.m.ehime-u.acjp/.about.yasuhito-/Elisa.html; www.biodesign.com/table.asp; www.icnet.uk/axp/facs/davies/links.html; www.biotech.ufl.edu/.about.fccl/protocol.html; www.isac-net.org/sites_geo.html; aximtl.imt.uni-marburg.de/.about.rek/AEP-Start.html; baserv.uci.kun.nl/.aboutjraats/linksl.html; www.recab.uni-hd.de/immuno bme.nwu.edu/; www.mrc-cpe.cam.ac.uk/imt-doc/pu-blic/INTRO.html; www.ibt.unam.mx/vir/V_mice.html; imgt.cnusc.fr:8104/; www.biochem.ucl.ac.uk/.about.martin/abs/index.html; antibody.bath.ac.uk/; abgen.cvm.tamu.edu/lab/ wwwabgen.html; www.unizh.ch/.about.honegger/AHOseminar/Slide01.html; www.cryst.bbk.ac.uk/.about.ubcg07s/; www.nimr mrc.ac.uk/CC/ccaewg/ccaewg.htm; www.path.cam.ac.uk/.about.mrc7/h-umanisation/TAHHP.html; www.ibt.unam.mx/vir/structure/stat_aim.html; www.biosci.missouri.edu/smithgp/index.html; www.cryst.bioc.cam.ac.uk/.abo-ut.finolina/Web-pages/Pept/spottech.html; wwwjerini.de/frroducts.htm; www.patents.ibm.com/ibm.html.Kabat et al., Sequences of Proteins of Immunological Interest, U.S. Dept. Health (1983), each entirely incorporated herein by reference. Such imported sequences can be used to reduce immunogenicity or reduce, enhance or modify binding, affinity, on-rate, off-rate, avidity, specificity, half-life, or any other suitable characteristic, as known in the art.

Framework (FR) residues in the human framework regions may be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. See, e.g., Queen et al., U.S. Pat. No. 5,585,089; Riechmann et al., Nature, 332: 323-327 (1988), which are incorporated herein by reference in their entireties. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequences so that the desired antibody characteristic, such as increased affinity for the target antigen(s), is achieved. In general, the CDR residues are directly and most substantially involved in influencing antigen binding. Antibodies can be humanized using a variety of techniques known in the art, such as but not limited to those described in Jones et al., Nature, 321:522-525 (1986); Verhoeyen et al., Science, 239:1534-1536 (1988); Sims et al., J. Immunol., 151: 2296-2308 (1993); Chothia and Lesk, J. Mol. Biol., 196: 901-917 (1987), Carter et al., Proc. Natl. Acad. Sci. USA, 89: 4285-4289 (1992); Presta et al., J. Immunol., 151: 2623-2632 (1993); Padlan, Molecular Immunology, 28(4/5): 489-498 (1991); Studnicka et al., Protein Engineering, 7(6): 805-814 (1994); Roguska et al., Proc. Natl. Acad. Sci. USA, 91: 969-973 (1994); PCT Publication Nos. WO 91/09967; WO 90/14443; WO 90/14424; WO 90/14430; WO 99/06834 (PCT/US98/16280); WO 97/20032 (PCT/US96/18978); WO 92/11272 (PCT/US91/09630); WO 92/03461 (PCT/US91/05939); WO 94/18219 (PCT/US94/01234); WO 92/01047 (PCT/GB91/01134); and WO 93/06213 (PCT/GB92/01755); EP Patent Nos. EP 0 592 106; EP 0 519 596 and EP 0 239 400; U.S. Pat. Nos. 5,565,332; 5,723,323; 5,976,862; 5,824,514; 5,817,483; 5,814,476; 5,763,192; 5,723,323; 5,766,886; 5,714,352; 6,204,023; 6,180,370; 5,693,762; 5,530,101; 5,585,089; 5,225,539 and 4,816,567, each entirely incorporated herein by reference, included references cited therein.

5. Anti IL-17 DVD-Ig™ Binding Proteins

Also provided are dual variable domain immunoglobulin binding proteins (DVD-Igs) that bind one or more epitopes of IL-17, the IL-17A monomer, the IL-17A dimer, the IL-17F monomer, and the IL-17A/IL-17F heterodimer A DVD-Ig binding protein may also bind an epitope of IL-17 and an epitope of a second target antigen other than an IL-17A and/or IL-17F polypeptide. A preferred embodiment of such DVD-Ig molecules comprises a heavy chain that comprises the structural formula VD1-(X1)n-VD2-C-(X2)n, wherein VD1 is a first heavy chain variable domain, VD2 is a second heavy chain variable domain, C is a heavy chain constant domain, X1 is a linker with the proviso that it is not CH1, X2 is an Fc region, and n is 0 or 1, and preferably 1; and a light chain that comprises the structural formula VD1-(X1)n-VD2-C-(X2)n, wherein VD1 is a first light chain variable domain, VD2 is a second light chain variable domain, C is a light chain constant domain, X1 is a linker with the proviso that it is not CH1, and X2 does not comprise an Fc region; and n is 0 or 1, and preferably 1. Such a DVD-Ig may comprise two such heavy chains and two such light chains, wherein each chain comprises variable domains linked in tandem without an intervening constant region between variable regions, wherein a heavy chain and a light chain associate to form two tandem antigen binding sites, and a pair of heavy and light chains may associate with another pair of heavy and light chains to form a tetrameric binding protein with four antigen binding sites. In another embodiment, a DVD-Ig molecule may comprise heavy and light chains that each comprise three variable domains, e.g., VD1, VD2, VD3, linked in tandem without an intervening constant region between variable domains, wherein a pair of heavy and light chains may associate to form three antigen binding sites, and wherein a pair of heavy and light chains may associate with another pair of heavy and light chains to form a tetrameric binding protein with six antigen binding sites.

Each variable domain (VD) in a DVD-Ig may be obtained from one or more "parent" monoclonal antibodies that bind one or more desired antigens or epitopes, such as IL-17, IL-17F, and/or non-IL-17 antigens or epitopes (e.g., TNF-α).

A. Generation of Parent Monoclonal Antibodies

The variable domains of the DVD-Ig binding protein can be obtained from parent antibodies, including monoclonal antibodies (mAb), capable of binding antigens of interest. These antibodies may be naturally occurring or may be generated by recombinant technology. It is understood that if an antibody that binds a desired target antigen or epitope is polyclonal then it is still necessary to obtain the variable domains of an antigen binding site of a single antibody from the polyclonal population, i.e., of a single monoclonal member of the polyclonal population, for use in generating a DVD-Ig. Monoclonal antibodies may be generated by any of variety of methods known in the art, including those described herein (see, sections A.1.-A.4., above).

B. Criteria for Selecting Parent Monoclonal Antibodies

An embodiment of the invention pertains to selecting parent antibodies with at least one or more properties desired in the DVD-Ig molecule. In an embodiment, the desired property is selected from one or more antibody parameters. In another embodiment, the antibody parameters are selected from the group consisting of antigen specificity, affinity to antigen, potency, biological function, epitope recognition, stability, solubility, production efficiency, immunogenicity, pharmacokinetics, bioavailability, tissue cross reactivity, and orthologous antigen binding.

B1. Affinity to Antigen

The desired affinity of a therapeutic mAb may depend upon the nature of the antigen, and the desired therapeutic endpoint. In an embodiment, monoclonal antibodies have higher affinities (Kd=0.01-0.50 pM) when blocking a cytokine-cytokine receptor interaction as such interaction are usually high affinity interactions (e.g., <pM-<nM ranges). In such instances, the mAb affinity for its target should be equal to or better than the affinity of the cytokine (ligand) for its receptor. On the other hand, mAb with lesser affinity (>nM range) could be therapeutically effective, e.g., in clearing circulating potentially pathogenic proteins e.g., monoclonal antibodies that bind to, sequester, and clear circulating species of a target antigen, such as A-β amyloid. In other instances, reducing the affinity of an existing high affinity mAb by site-directed mutagenesis or using a mAb with lower affinity for its target could be used to avoid potential side-effects, e.g., a high affinity mAb may sequester or neutralize all of its intended target, thereby completely depleting/eliminating the function(s) of the targeted protein. In this scenario, a low affinity mAb may sequester/neutralize a fraction of the target that may be responsible for the disease symptoms (the pathological or over-produced levels), thus allowing a fraction of the target to continue to perform its normal physiological function(s). Therefore, it may be possible to reduce the Kd to adjust dose and/or reduce side-effects. The affinity of the parental mAb might play a role in appropriately targeting cell surface molecules to achieve desired therapeutic out-come. For example, if a target is expressed on cancer cells with high density and on normal cells with low density, a lower affinity mAb will bind a greater number of targets on tumor cells than normal cells, resulting in tumor cell elimination via ADCC or CDC, and therefore might have therapeutically desirable effects. Thus, selecting a mAb with desired affinity may be relevant for both soluble and surface targets.

Signaling through a receptor upon interaction with its ligand may depend upon the affinity of the receptor-ligand interaction. Similarly, it is conceivable that the affinity of a mAb for a surface receptor could determine the nature of intracellular signaling and whether the mAb may deliver an agonist or an antagonist signal. The affinity-based nature of mAb-mediated signaling may have an impact of its side-effect profile. Therefore, the desired affinity and desired functions of therapeutic monoclonal antibodies need to be determined carefully by in vitro and in vivo experimentation.

The desired Kd of a binding protein (e.g., an antibody) may be determined experimentally depending on the desired therapeutic outcome. In an embodiment, parent antibodies with affinity (Kd) for a particular antigen equal to, or better than, the desired affinity of the DVD-Ig for the same antigen are selected. The antigen binding affinity and kinetics are assessed by Biacore or another similar technique. In one embodiment, each parent antibody has a dissociation constant (Kd) to its antigen selected from the group consisting of: at most about $10^{-7}$ M; at most about $10^{-8}$ M; at most about $10^{-9}$ M; at most about $10^{-10}$ M; at most about $10^{-11}$ M; at most about $10^{-12}$ M; and at most $10^{-13}$ M. First parent antibody from which VD1 is obtained and second parent antibody from which VD2 is obtained may have similar or different affinity ($K_D$) for the respective antigen. Each parent antibody has an on rate constant (Kon) to the antigen selected from the group consisting of: at least about $10^2 M^{-1}s^{-1}$; at least about $10^3 M^{-1}s^{-1}$; at least about $10^4 M^{-1}s^{-1}$; at least about $10^5 M^{-1}s^{-1}$; and at least about $10^6 M^{-1}s^{-1}$, as measured by surface plasmon resonance. The first parent antibody from which, for example, a VD1 is obtained and the second parent antibody from which a VD2 is obtained may have similar or different on rate constant (Kon) for the respective antigen. In one embodiment, each parent antibody has an off rate constant (Koff) to the antigen selected from the group consisting of: at most about $10^{-3}s^{-1}$; at most about $10^{-4}s^{-1}$; at most about $10^{-5}s^{-1}$; and at most about $10^{-6}s^{-1}$, as measured by surface plasmon resonance. The first parent antibody from which VD1 is obtained and the second parent antibody from which VD2 is obtained may have similar or different off rate constants (Koff) for the respective antigen.

B2. Potency

The desired affinity/potency of parental monoclonal antibodies will depend on the desired therapeutic outcome. For example, for receptor-ligand (R-L) interactions the affinity (kd) is equal to or better than the R-L kd (pM range). For simple clearance of a pathologic circulating proteins, the Kd could be in low nM range, e.g., clearance of various species of circulating A-β peptide. In addition, the Kd will also depend on whether the target expresses multiple copies of the same epitope, e.g., an mAb targeting conformational epitope in Aβ oligomers.

Where VD1 and VD2 bind the same antigen, but distinct epitopes, the DVD-Ig will contain binding sites for the same antigen, thus increasing avidity and thereby the apparent Kd of the DVD-Ig. In an embodiment, parent antibodies with equal or lower Kd than that desired in the DVD-Ig are chosen. The affinity considerations of a parental mAb may also depend upon whether the DVD-Ig contains four or more identical antigen binding sites (i.e., a DVD-Ig from a single mAb). In this case, the apparent Kd would be greater than the mAb due to avidity. Such DVD-Igs can be employed for cross-linking surface receptor, increased neutralization potency, enhanced clearance of pathological proteins, etc.

In another embodiment, parent antibodies with neutralization potency for specific antigen equal to or better than the desired neutralization potential of the DVD-Ig for the same antigen are selected. The neutralization potency can be assessed by a target-dependent bioassay where cells of appropriate type produce a measurable signal (i.e., proliferation or cytokine production) in response to target stimulation, and target neutralization by the mAb can reduce the signal in a dose-dependent manner.

B3. Biological Functions

Monoclonal antibodies can perform potentially several functions. Some of these functions are listed in Table 8. These functions can be assessed by both in vitro assays (e.g., cell-based and biochemical assays) and in vivo animal models.

TABLE 8

| Some Potential Applications For Therapeutic Antibodies. | |
|---|---|
| Target (Class) | Mechanism of Action (target) |
| Soluble (cytokines, other) | Neutralization of activity (e.g., a cytokine, such IL-17) Enhance clearance (e.g., Aβ oligomers) Increase half-life (e.g., GLP 1) |
| Cell Surface (Receptors, other) | Agonist (e.g., GLP1 R, EPO R, etc.) Antagonist (e.g., integrins, etc.) Cytotoxic (CD 20, etc.) |
| Protein deposits | Enhance clearance/degradation (e.g., Aβ plaques, amyloid deposits) |

MAbs with distinct functions described in the examples herein and in Table 8 can be selected to achieve desired therapeutic outcomes. Two or more selected parent monoclonal antibodies can then be used in DVD-Ig format to achieve two distinct functions in a single DVD-Ig molecule. For example, a DVD-Ig can be generated by selecting a parent mAb that neutralizes function of a specific cytokine, such as IL-17, and selecting a parent mAb that enhances clearance of a pathological protein. Similarly, two parent mAbs may be selected that recognize two different cell surface receptors, one mAb with an agonist function on one receptor and the other mAb with an antagonist function on a different receptor. These two selected mAbs, each with a distinct function, can be used to construct a single DVD-Ig molecule that will possess the two distinct functions (agonist and antagonist) of the selected monoclonal antibodies in a single molecule. Similarly, two antagonistic mAbs to cell surface receptors, each blocking binding of respective receptor ligands (e.g., EGF and IGF), may be used in a DVD-Ig format. Conversely, an antagonistic anti-receptor mAb (e.g., anti-EGFR) and a neutralizing anti-soluble mediator (e.g., anti-IGF1/2) mAb can be selected to make a DVD-Ig.

B4. Epitope Recognition:

Different regions of proteins may perform different functions. For example, specific regions of a cytokine, such as IL-17, interact with the cytokine receptor to bring about receptor activation whereas other regions of the protein may be required for stabilizing the cytokine. In this instance, one may select a mAb that binds specifically to the receptor interacting region(s) on the cytokine and thereby block cytokine-receptor interaction. In some cases, for example certain chemokine receptors that bind multiple ligands, a mAb that binds to the epitope (region on chemokine receptor) that interacts with only one ligand can be selected. In other instances, monoclonal antibodies can bind to epitopes on a target that are not directly responsible for physiological functions of the protein, but binding of a mAb to these regions could either interfere with physiological functions (steric hindrance) or alter the conformation of the protein such that the protein cannot function (mAb to receptors with multiple ligand which alter the receptor conformation such that none of the ligand can bind). Anti-cytokine monoclonal antibodies that do not block binding of the cytokine to its receptor, but block signal transduction have also been identified (e.g., 125-2H, an anti-IL-18 mAb).

Examples of epitopes and mAb functions include, but are not limited to, blocking Receptor-Ligand (R-L) interaction (neutralizing mAb that binds R-interacting site); steric hindrance resulting in diminished or no R-binding. An antibody can bind the target at a site other than a receptor binding site, but still interfere with receptor binding and functions of the target by inducing conformational change and eliminate function (e.g., XOLAIR® omalizumab, Genetech/Novartis), binding to R but block signaling (125-2H mAb).

In an embodiment, the parental mAb needs to target the appropriate epitope for maximum efficacy. Such epitope should be conserved in the DVD-Ig. The binding epitope of a mAb can be determined by several approaches, including co-crystallography, limited proteolysis of mAb-antigen complex plus mass spectrometric peptide mapping (Legros V. et al 2000 Protein Sci. 9:1002-10), phage displayed peptide libraries (O'Connor K H et al 2005 J Immunol Methods. 299:21-35), as well as mutagenesis (Wu C. et al. 2003 J Immunol 170:5571-7).

B5. Physicochemical and Pharmaceutical Properties:

Therapeutic treatment with antibodies often requires administration of high doses, often several mg/kg (due to a low potency on a mass basis as a consequence of a typically large molecular weight). In order to accommodate patient compliance and to adequately address chronic disease therapies and outpatient treatment, subcutaneous (s.c.) or intramuscular (i.m.) administration of therapeutic mAbs is desirable. For example, the maximum desirable volume for s.c. administration is ~1.0 mL, and therefore, concentrations of >100 mg/mL are desirable to limit the number of injections per dose. In an embodiment, the therapeutic antibody is administered in one dose. The development of such formulations is constrained, however, by protein-protein interactions (e.g., aggregation, which potentially increases immunogenicity risks) and by limitations during processing and delivery (e.g., viscosity). Consequently, the large quantities required for clinical efficacy and the associated development constraints limit full exploitation of the potential of antibody formulation and s.c. administration in high-dose regimens. It is apparent that the physicochemical and pharmaceutical properties of a protein molecule and the protein solution are of utmost importance, e.g., stability, solubility and viscosity features.

B5.1. Stability

A "stable" antibody formulation is one in which the antibody therein essentially retains its physical stability and/or chemical stability and/or biological activity upon storage. Stability can be measured at a selected temperature for a selected time period. In an embodiment, the antibody in the formulation is stable at room temperature (about 30° C.) or at 40° C. for at least 1 month and/or stable at about 2-8° C. for at least 1 year for at least 2 years. Furthermore, in an embodiment, the formulation is stable following freezing (to, e.g., −70° C.) and thawing of the formulation, hereinafter referred to as a "freeze/thaw cycle." In another example, a "stable" formulation may be one wherein less than about 10% and less than about 5% of the protein is present as an aggregate in the formulation.

A DVD-Ig stable in vitro at various temperatures for an extended time period is desirable. One can achieve this by rapid screening of parental mAbs stable in vitro at elevated temperature, e.g., at 40° C. for 2-4 weeks, and then assess stability. During storage at 2-8° C., the protein reveals stability for at least 12 months, e.g., at least 24 months. Stability (% of monomeric, intact molecule) can be assessed using various techniques such as cation exchange chromatography, size exclusion chromatography, SDS-PAGE, as well as bioactivity testing. For a more comprehensive list of analytical techniques that may be employed to analyze covalent and conformational modifications, see, Jones, A. J. S. (1993) "Analytical methods for the assessment of protein formulations and delivery systems," In Cleland, J. L.; Langer, R., editors. *Formulation and delivery of peptides and proteins,* 1st edition, (Washington, ACS), pages 22-45; and Pearlman, R.; Nguyen, T. H. (1990) "Analysis of protein drugs," In Lee, V. H., editor. *Peptide and protein drug delivery,* 1st edition (New York, Marcel Dekker, Inc.) pages 247-301.

Heterogeneity and aggregate formation: stability of the antibody may be such that the formulation may reveal less than about 10%, and, in an embodiment, less than about 5%, in another embodiment, less than about 2%, or, in an embodiment, within the range of 0.5% to 1.5% or less in the GMP antibody material that is present as aggregate. Size exclusion chromatography is a method that is sensitive, reproducible, and very robust in the detection of protein aggregates.

In addition to low aggregate levels, the antibody must, in an embodiment, be chemically stable. Chemical stability may be determined by ion exchange chromatography (e.g., cation or anion exchange chromatography), hydrophobic interaction chromatography, or other methods such as isoelectric focusing or capillary electrophoresis. For instance, chemical stability of the antibody may be such that after storage of at least 12 months at 2-8° C. the peak representing unmodified antibody in a cation exchange chromatography may increase not more than 20%, in an embodiment, not more than 10%, or, in another embodiment, not more than 5% as compared to the antibody solution prior to storage testing.

In an embodiment, the parent antibodies display structural integrity; correct disulfide bond formation, and correct folding: Chemical instability due to changes in secondary or tertiary structure of an antibody may impact antibody activity. For instance, stability as indicated by activity of the antibody may be such that after storage of at least 12 months at 2-8° C.

the activity of the antibody may decrease not more than 50%, in an embodiment not more than 30%, or even not more than 10%, or in an embodiment not more than 5% or 1% as compared to the antibody solution prior to storage testing. Suitable antigen-binding assays can be employed to determine antibody activity.

B5.2. Solubility:

The "solubility" of a mAb correlates with the production of correctly folded, monomeric IgG. The solubility of the IgG may therefore be assessed by HPLC. For example, soluble (monomeric) IgG will give rise to a single peak on the HPLC chromatograph, whereas insoluble (e.g., multimeric and aggregated) will give rise to a plurality of peaks. A person skilled in the art will therefore be able to detect an increase or decrease in solubility of an IgG using routine HPLC techniques. For a more comprehensive list of analytical techniques that may be employed to analyze solubility (see, Jones, A. G. Dep. Chem. Biochem. Eng., Univ. Coll. London, London, UK. Editor(s): Shamlou, P. Ayazi, *Process. Solid-Liquid Suspensions* (1993), 93-117. (Butterworth-Heinemann, Oxford, UK) and Pearlman, Rodney; Nguyen, Tue H, Advances in Parenteral Sciences (1990), 4 (Pept. Protein Drug Delivery), 247-301. Solubility of a therapeutic mAb is critical for formulating to high concentration often required for adequate dosing. As outlined herein, solubilities of >100 mg/mL may be required to accommodate efficient antibody dosing. For instance, antibody solubility may be not less than about 5 mg/mL in early research phase, in an embodiment not less than about 25 mg/mL in advanced process science stages, or in an embodiment not less than about 100 mg/mL, or in an embodiment not less than about 150 mg/mL. The intrinsic properties of a protein molecule are important to the physicochemical properties of the protein solution, e.g., stability, solubility, viscosity. However, a person skilled in the art will appreciate that a broad variety of excipients exist that may be used as additives to beneficially impact the characteristics of the final protein formulation. These excipients may include: (i) liquid solvents, cosolvents (e.g., alcohols such as ethanol); (ii) buffering agents (e.g., phosphate, acetate, citrate, amino acid buffers); (iii) sugars or sugar alcohols (e.g., sucrose, trehalose, fructose, raffinose, mannitol, sorbitol, dextrans); (iv) surfactants (e.g., polysorbate 20, 40, 60, 80, poloxamers); (v) isotonicity modifiers (e.g., salts such as NaCl, sugars, sugar alcohols); and (vi) others (e.g., preservatives, chelating agents, antioxidants, chelating substances (e.g., EDTA), biodegradable polymers, carrier molecules (e.g., HSA, PEGs)

Viscosity is a parameter of high importance with regard to antibody manufacture and antibody processing (e.g., diafiltration/ultrafiltration), fill-finish processes (pumping aspects, filtration aspects) and delivery aspects (syringeability, sophisticated device delivery). Low viscosities enable the liquid solution of the antibody having a higher concentration. This enables the same dose to be administered in smaller volumes. Small injection volumes inhere the advantage of lower pain on injection sensations, and the solutions do not necessarily have to be isotonic to reduce pain on injection in the patient. The viscosity of the antibody solution may be such that at shear rates of 100 (1/s) antibody solution viscosity is below 200 mPa s, in an embodiment below 125 mPa s, in another embodiment below 70 mPa s, and in yet another embodiment below 25 mPa s or even below 10 mPa s.

B5.3. Production Efficiency

The generation of a DVD-Ig that is efficiently expressed in mammalian cells, such as Chinese hamster ovary cells (CHO), will in an embodiment require two parental monoclonal antibodies which are themselves expressed efficiently in mammalian cells. The production yield from a stable mammalian line (i.e., CHO) should be above about 0.5 g/L, in an embodiment above about 1 g/L, and in another embodiment in the range of about 2 to about 5 g/L or more (Kipriyanov S M, Little M. 1999 Mol Biotechnol. 12:173-201; Carroll S, Al-Rubeai M. 2004 Expert Opin Biol Ther. 4:1821-9).

Production of antibodies and Ig fusion proteins in mammalian cells is influenced by several factors. Engineering of the expression vector via incorporation of strong promoters, enhancers and selection markers can maximize transcription of the gene of interest from an integrated vector copy. The identification of vector integration sites that are permissive for high levels of gene transcription can augment protein expression from a vector (Wurm et al, 2004, *Nature Biotechnology*, 2004, 22(11): 1393-1398). Furthermore, levels of production are affected by the ratio of antibody heavy and light chains and various steps in the process of protein assembly and secretion (Jiang et al. 2006, Biotechnology Progress, January-February 2006, vol. 22, no. 1, pp. 313-318).

B6. Immunogenicity

Administration of a therapeutic mAb may result in certain incidence of an immune response (i.e., the formation of endogenous antibodies directed against the therapeutic mAb). Potential elements that might induce immunogenicity should be analyzed during selection of the parental monoclonal antibodies, and steps to reduce such risk can be taken to optimize the parental monoclonal antibodies prior to DVD-Ig construction. Mouse-derived antibodies have been found to be highly immunogenic in patients. The generation of chimeric antibodies comprised of mouse variable and human constant regions presents a logical next step to reduce the immunogenicity of therapeutic antibodies (Morrison and Schlom, 1990). Alternatively, immunogenicity can be reduced by transferring murine CDR sequences into a human antibody framework (reshaping/CDR grafting/humanization), as described for a therapeutic antibody by Riechmann et al., 1988. Another method is referred to as "resurfacing" or "veneering", starting with the rodent variable light and heavy domains, only surface-accessible framework amino acids are altered to human ones, while the CDR and buried amino acids remain from the parental rodent antibody (Roguska et al., 1996). In another type of humanization, instead of grafting the entire CDRs, one technique grafts only the "specificity-determining regions" (SDRs), defined as the subset of CDR residues that are involved in binding of the antibody to its target (Kashmiri et al., 2005). This necessitates identification of the SDRs either through analysis of available three-dimensional structures of antibody-target complexes or mutational analysis of the antibody CDR residues to determine which interact with the target. Alternatively, fully human antibodies may have reduced immunogenicity compared to murine, chimeric, or humanized antibodies.

Another approach to reduce the immunogenicity of therapeutic antibodies is the elimination of certain specific sequences that are predicted to be immunogenic. In one approach, after a first generation biologic has been tested in humans and found to be unacceptably immunogenic, the B-cell epitopes can be mapped and then altered to avoid immune detection. Another approach uses methods to predict and remove potential T-cell epitopes. Computational methods have been developed to scan and to identify the peptide sequences of biologic therapeutics with the potential to bind to MHC proteins (Desmet et al., 2005). Alternatively a human dendritic cell-based method can be used to identify $CD4^+$ T-cell epitopes in potential protein allergens (Stickler et al., 2005; S. L. Morrison and J. Schlom, *Important Adv. Oncol.* (1990), pp. 3-18; Riechmann, L., Clark, M., Waldmann, H. and Winter, G. "Reshaping human antibodies for therapy,"

Nature (1988) 332: 323-327; Roguska-M-A, Pedersen-J-T, Henry-A-H, Searle-S-M, Roja-C-M, Avery-B, Hoffee-M, Cook-S, Lambert-J-M, Blättler-W-A, Rees-A-R, Guild-B-C, "A comparison of two murine mAbs humanized by CDR-grafting and variable domain resurfacing," *Protein Engineering*, (1996), 9:. 895-904; Kashmiri-Syed-V-S, De-Pascalis-Roberto, Gonzales-Noreen-R, Schlom-Jeffrey, "SDR grafting—a new approach to antibody humanization," *Methods* (San Diego Calif.), May 2005, 36(1): 25-34; Desmet-Johan, Meersseman-Geert, Boutonnet-Nathalie, Pletinckx-Jurgen, De-Clercq-Krista, Debulpaep-Maja, Braeckman-Tessa, Lasters-Ignace, "Anchor profiles of HLA-specific peptides: analysis by a novel affinity scoring method and experimental validation," *Proteins* (2005) 58: 53-69; Stickler-M-M, Estell-D-A, Harding-F-A., "CD4+ T-cell epitope determination using unexposed human donor peripheral blood mononuclear cells," *J. Immunother.* (2000) 23: 654-60.)

B7. In Vivo Efficacy

To generate a DVD-Ig molecule with desired in vivo efficacy, it is important to generate and select mAbs with similarly desired in vivo efficacy when given in combination. However, in some instances the DVD-Ig may exhibit in vivo efficacy that cannot be achieved with the combination of two separate mAbs. For instance, a DVD-Ig may bring two targets in close proximity leading to an activity that cannot be achieved with the combination of two separate mAbs. Additional desirable biological functions are described herein in section B3. Parent antibodies with characteristics desirable in the DVD-Ig molecule may be selected based on factors such as pharmacokinetic half-life (t½); tissue distribution; soluble versus cell surface targets; and target concentration—soluble/density—surface.

B8. In Vivo Tissue Distribution

To generate a DVD-Ig molecule with desired in vivo tissue distribution, in an embodiment, parent mAbs with similar desired in vivo tissue distribution profile must be selected. Alternatively, based on the mechanism of the dual-specific targeting strategy, it may at other times not be required to select parent mAbs with the similarly desired in vivo tissue distribution when given in combination. For instance, in the case of a DVD-Ig in which one binding component targets the DVD-Ig to a specific site thereby bringing the second binding component to the same target site. For example, one binding specificity of a DVD-Ig could target pancreas (islet cells) and the other specificity could bring GLP1 to the pancreas to induce insulin.

B9. Isotype

To generate a DVD-Ig molecule with desired properties including, but not limited to, isotype, effector functions, and the circulating half-life, parent mAbs are selected that possess appropriate Fc-effector functions depending on the therapeutic utility and the desired therapeutic end-point. There are five main heavy chain classes or isotypes, some of which have several sub-types and these determine the effector functions of an antibody molecule. These effector functions reside in the hinge region, CH2, and CH3 domains of the antibody molecule. However, residues in other parts of an antibody molecule may have effects on effector functions as well. The hinge region Fc-effector functions include: (i) antibody-dependent cellular cytotoxicity (ADCC), (ii) complement (Clq) binding, activation, and complement-dependent cytotoxicity (CDC), (iii) phagocytosis/clearance of antigen-antibody complexes, and (iv) cytokine release in some instances. These Fc-effector functions of an antibody molecule are mediated through the interaction of the Fc-region with a set of class-specific cell surface receptors. Antibodies of the IgG1 isotype are most active while IgG2 and IgG4 having minimal or no effector functions. The effector functions of the IgG antibodies are mediated through interactions with three structurally homologous cellular Fc receptor types (and sub-types) (FcgR1, FcgRII, and FcgRIII). These effector functions of an IgG1 can be eliminated by mutating specific amino acid residues in the lower hinge region (e.g., L234A, L235A) that are required for FcgR and Clq binding Amino acid residues in the Fc region, in particular the CH2-CH3 domains, also determine the circulating half-life of the antibody molecule. This Fc function is mediated through the binding of the Fc-region to the neonatal Fc receptor (FcRn), which is responsible for recycling of antibody molecules from the acidic lysosomes back to the general circulation.

Whether a mAb should have an active or an inactive isotype will depend on the desired therapeutic end-point for an antibody. Some examples of usage of isotypes and desired therapeutic outcome are listed below:

1. If the desired end-point is functional neutralization of a soluble cytokine then an inactive isotype may be used;
2. If the desired out-come is clearance of a pathological protein an active isotype may be used;
3. If the desired out-come is clearance of protein aggregates an active isotype may be used;
4. If the desired outcome is to antagonize a surface receptor an inactive isotype is used (Tysabri, IgG4; OKT3®, mutated IgG1);
5. If the desired outcome is to eliminate target cells an active isotype is used (Herceptin, IgG1 (and with enhanced effector functions); and
6. If the desired outcome is to clear proteins from circulation without entering the CNS an IgM isotype may be used (e.g., clearing circulating Ab peptide species).

The Fc effector functions of a parental mAb can be determined by various in vitro methods well known in the art.

As discussed, the selection of isotype, and thereby the effector functions will depend upon the desired therapeutic end-point. In cases where simple neutralization of a circulating target is desired, for example blocking receptor-ligand interactions, the effector functions may not be required. In such instances, isotypes or mutations in the Fc-region of an antibody that eliminate effector functions are desirable. In other instances where elimination of target cells is the therapeutic end-point, for example elimination of tumor cells, isotypes or mutations or de-fucosylation in the Fc-region that enhance effector functions are desirable (Presta GL, *Adv. Drug Delivery Rev.*, 58: 640-656, 2006; Satoh M., Iida S., Shitara K., *Expert Opinion Biol. Ther.*, 6: 1161-1173, 2006). Similarly, depending up on the therapeutic utility, the circulating half-life of an antibody molecule can be reduced/prolonged by modulating antibody-FcRn interactions by introducing specific mutations in the Fc region (Dall'Acqua W F, Kiener P A, Wu H., *J. Biol. Chem.*, 281: 23514-23524 (2006); Petkova S B., Akilesh S., Sproule T J. et al., *Internat. Immunol.*, 18: 1759-1769 (2006); Vaccaro C., Bawdon R., Wanjie S et al., *Proc. Natl. Acad. Sci. USA*, 103: 18709-18714 (2007).

The published information on the various residues that influence the different effector functions of a normal therapeutic mAb may need to be confirmed for a DVD-Ig. It may be possible that in a DVD-Ig format additional (different) Fc-region residues, other than those identified for the modulation of monoclonal antibody effector functions, may be important.

Overall, the decision as to which Fc-effector functions (isotype) will be critical in the final DVD-Ig format will depend up on the disease indication, therapeutic target, desired therapeutic end-point, and safety considerations.

Listed below are exemplary appropriate heavy chain and light chain constant regions including, but not limited to:
  IgG1—allotype: G1mz
  IgG1 mutant—A234, A235
  IgG2—allotype: G2m(n−)
  Kappa—Km3
  Lambda
  Fc Receptor and C1q Studies:

The possibility of unwanted antibody-dependent cell-mediated cytotoxicity (ADCC) and complement-dependent cytotoxicity (CDC) by antibody complexing to any overexpressed target on cell membranes can be abrogated by (for example, L234A, L235A) hinge-region mutations. These substituted amino acids, present in the IgG1 hinge region of mAb, are expected to result in diminished binding of mAb to human Fc receptors (but not FcRn), as FcgR binding is thought to occur within overlapping sites on the IgG1 hinge region. This feature of mAb may lead to an improved safety profile over antibodies containing a wild-type IgG. Binding of mAb to human Fc receptors can be determined by flow cytometry experiments using cell lines (e.g., THP-1, K562) and an engineered CHO cell line that expresses FcgRIIb (or other FcgRs). Compared to IgG1 control monoclonal antibodies, mAb show reduced binding to FcgRI and FcgRIIa whereas binding to FcgRIIb is unaffected. The binding and activation of C1q by antigen/IgG immune complexes triggers the classical complement cascade with consequent inflammatory and/or immunoregulatory responses. The C1q binding site on IgGs has been localized to residues within the IgG hinge region. C1q binding to increasing concentrations of mAb was assessed by C1q ELISA. The results demonstrate that mAb is unable to bind to C1q, as expected when compared to the binding of a wildtype control IgG1. Overall, the L234A, L235A hinge region mutation abolishes binding of mAb to FcgRI, FcgRIIa, and C1q, but does not impact the interaction of mAb with FcgRIIb. These data suggest that in vivo mAb with mutant Fc will interact normally with the inhibitory FcgRIIb but will likely fail to interact with the activating FcgRI and FcgRIIa receptors or C1q.

Human FcRn Binding:

The neonatal receptor (FcRn) is responsible for transport of IgG across the placenta and to control the catabolic half-life of the IgG molecules. It might be desirable to increase the terminal half-life of an antibody to improve efficacy, to reduce the dose or frequency of administration, or to improve localization to the target. Alternatively, it might be advantageous to do the converse that is, to decrease the terminal half-life of an antibody to reduce whole body exposure or to improve the target-to-non-target binding ratios. Tailoring the interaction between IgG and its salvage receptor, FcRn, offers a way to increase or decrease the terminal half-life of IgG. Proteins in the circulation, including IgG, are taken up in the fluid phase through micropinocytosis by certain cells, such as those of the vascular endothelia. IgG can bind FcRn in endosomes under slightly acidic conditions (pH 6.0-6.5) and can recycle to the cell surface, where it is released under almost neutral conditions (pH 7.0-7.4). Mapping of the Fc-region-binding site on FcRn80, 16, 17 showed that two histidine residues that are conserved across species, His310 and His435, are responsible for the pH dependence of this interaction. Using phage-display technology, a mouse Fc-region mutation that increases binding to FcRn and extends the half-life of mouse IgG was identified (see Victor, G. et al., *Nature Biotechnology*, 15(7): 637-640 (1997)). Fc-region mutations that increase the binding affinity of human IgG for FcRn at pH 6.0, but not at pH 7.4, have also been identified (see, Dall'Acqua et al., *J. Immunol.*, 169(9): 5171-80 (2002)).

Moreover, in one case, a similar pH-dependent increase in binding (up to 27-fold) was also observed for rhesus FcRn, and this resulted in a twofold increase in serum half-life in rhesus monkeys compared with the parent IgG (see, Hinton et al., *J. Biol. Chem.*, 279(8): 6213-6216 (2004)). These findings indicate that it is feasible to extend the plasma half-life of antibody therapeutics by tailoring the interaction of the Fc region with FcRn. Conversely, Fc-region mutations that attenuate interaction with FcRn can reduce antibody half-life.

B.10. Pharmacokinetics (PK)

To generate a DVD-Ig molecule with desired pharmacokinetic profile, in an embodiment, parent mAbs with the similarly desired pharmacokinetic profile are selected. One consideration is that immunogenic response to monoclonal antibodies (i.e., "HAHA", human anti-human antibody response; "HACA", human anti-chimeric antibody response) further complicates the pharmacokinetics of these therapeutic agents. In an embodiment, monoclonal antibodies with minimal or no immunogenicity are used for constructing DVD-Ig molecules such that the resulting DVD-Igs will also have minimal or no immunogenicity. Some of the factors that determine the PK of a mAb include, but are not limited to, intrinsic properties of the mAb (VH amino acid sequence); immunogenicity; FcRn binding and Fc functions.

The PK profile of selected parental monoclonal antibodies can be easily determined in rodents as the PK profile in rodents correlates well with (or closely predicts) the PK profile of monoclonal antibodies in cynomolgus monkey and humans.

After the parental monoclonal antibodies with desired PK characteristics (and other desired functional properties as discussed herein) are selected, the DVD-Ig is constructed. As the DVD-Ig molecules contain two antigen-binding domains from two parental monoclonal antibodies, the PK properties of the DVD-Ig are assessed as well. Therefore, while determining the PK properties of the DVD-Ig, PK assays may be employed that determine the PK profile based on functionality of both antigen-binding domains derived from the 2 parent monoclonal antibodies. The PK profile of a DVD-Ig can be determined. Additional factors that may impact the PK profile of DVD-Ig include the antigen-binding domain (CDR) orientation, linker size, and Fc/FcRn interactions. PK characteristics of parent antibodies can be evaluated by assessing the following parameters: absorption, distribution, metabolism and excretion.

Absorption:

To date, administration of therapeutic monoclonal antibodies is via parenteral routes (e.g., intravenous [IV], subcutaneous [SC], or intramuscular [IM]). Absorption of a mAb into the systemic circulation following either SC or IM administration from the interstitial space is primarily through the lymphatic pathway. Saturable, presystemic, proteolytic degradation may result in variable absolute bioavailability following extravascular administration. Usually, increases in absolute bioavailability with increasing doses of monoclonal antibodies may be observed due to saturated proteolytic capacity at higher doses. The absorption process for a mAb is usually quite slow as the lymph fluid drains slowly into the vascular system, and the duration of absorption may occur over hours to several days. The absolute bioavailability of monoclonal antibodies following SC administration generally ranges from 50% to 100%. In the case of a transport-mediating structure at the blood-brain barrier (BBB) targeted by the DVD-Ig construct, circulation times in plasma may be reduced due to enhanced trans-cellular transport at the blood brain barrier (BBB) into the CNS compartment, where the DVD-Ig is liberated to enable interaction via its second antigen recognition site.

Distribution:

Following IV administration, monoclonal antibodies usually follow a biphasic serum (or plasma) concentration-time profile, beginning with a rapid distribution phase, followed by a slow elimination phase. In general, a biexponential pharmacokinetic model best describes this kind of pharmacokinetic profile. The volume of distribution in the central compartment (Vc) for a mAb is usually equal to or slightly larger than the plasma volume (2-3 liters). A distinct biphasic pattern in serum (plasma) concentration versus time profile may not be apparent with other parenteral routes of administration, such as IM or SC, because the distribution phase of the serum (plasma) concentration-time curve is masked by the long absorption portion. Many factors, including physicochemical properties, site-specific and target-oriented receptor mediated uptake, binding capacity of tissue, and mAb dose can influence biodistribution of a mAb. Some of these factors can contribute to nonlinearity in biodistribution for a mAb.

Metabolism and Excretion:

Due to the molecular size, intact monoclonal antibodies are not excreted into the urine via kidney. They are primarily inactivated by metabolism (e.g., catabolism). For IgG-based therapeutic monoclonal antibodies, half-lives typically ranges from hours or 1-2 days to over 20 days. The elimination of a mAb can be affected by many factors, including, but not limited to, affinity for the FcRn receptor, immunogenicity of the mAb, the degree of glycosylation of the mAb, the susceptibility for the mAb to proteolysis, and receptor-mediated elimination.

B.11. Tissue Cross-Reactivity Pattern on Human and Tox Species

Identical staining pattern suggests that potential human toxicity can be evaluated in tox species. Tox species are those animal in which unrelated toxicity is studied.

The individual antibodies are selected to meet two criteria: (1) tissue staining appropriate for the known expression of the antibody target and (2) similar staining pattern between human and tox species tissues from the same organ.

Criterion 1: Immunizations and/or antibody selections typically employ recombinant or synthesized antigens (proteins, carbohydrates or other molecules). Binding to the natural counterpart and counterscreen against unrelated antigens are often part of the screening funnel for therapeutic antibodies. However, screening against a multitude of antigens is often unpractical. Therefore, tissue cross-reactivity studies with human tissues from all major organs serve to rule out unwanted binding of the antibody to any unrelated antigens.

Criterion 2: Comparative tissue cross reactivity studies with human and tox species tissues (cynomolgus monkey, dog, possibly rodents, and others, the same 36 or 37 tissues being tested as in the human study) help to validate the selection of a tox species. In the typical tissue cross-reactivity studies on frozen tissue sections, therapeutic antibodies may demonstrate the expected binding to the known antigen and/or to a lesser degree binding to tissues based either on low level interactions (unspecific binding, low level binding to similar antigens, low level charge based interactions, etc.). In any case, the most relevant toxicology animal species is the one with the highest degree of coincidence of binding to human and animal tissue.

Tissue cross-reactivity studies follow the appropriate regulatory guidelines including EC CPMP Guideline III/5271/94 "Production and quality control of mAbs" and the 1997 US FDA/CBER "Points to Consider in the Manufacture and Testing of Monoclonal Antibody Products for Human Use". Cryosections (5 μm) of human tissues obtained at autopsy or biopsy were fixed and dried on object glass. The peroxidase staining of tissue sections are performed, using the avidin-biotin system. FDA's Guidance "*Points to Consider in the Manufacture and Testing of Monoclonal Antibody Products for Human Use*". Relevant references include Clarke, J. (2004), Boon, L. (2002a), Boon, L. (2002b), Ryan, A. (1999).

Tissue-cross reactivity studies are often done in two stages, with the first stage including cryosections of 32 tissues (typically: Adrenal Gland, Gastrointestinal Tract, Prostate, Bladder, Heart, Skeletal Muscle, Blood Cells, Kidney, Skin, Bone Marrow, Liver, Spinal Cord, Breast, Lung, Spleen, Cerebellum, Lymph Node, Testes, Cerebral Cortex, Ovary, Thymus, Colon, Pancreas, Thyroid, Endothelium, Parathyroid, Ureter, Eye, Pituitary, Uterus, Fallopian Tube and Placenta) from one human donor. In the second phase, a full cross reactivity study is performed with up to 38 tissues (including adrenal, blood, blood vessel, bone marrow, cerebellum, cerebrum, cervix, esophagus, eye, heart, kidney, large intestine, liver, lung, lymph node, breast mammary gland, ovary, oviduct, pancreas, parathyroid, peripheral nerve, pituitary, placenta, prostate, salivary gland, skin, small intestine, spinal cord, spleen, stomach, striated muscle, testis, thymus, thyroid, tonsil, ureter, urinary bladder, and uterus) from three unrelated adults. Studies are done typically at minimally two dose levels.

The therapeutic antibody (i.e., test article) and isotype matched control antibody may be biotinylated for avidin-biotin complex (ABC) detection; other detection methods may include tertiary antibody detection for a FITC (or otherwise) labeled test article, or precomplexing with a labeled anti-human IgG for an unlabeled test article.

Briefly, cryosections (about 5 μm) of human tissues obtained at autopsy or biopsy are fixed and dried on object glass. The peroxidase staining of tissue sections is performed, using the avidin-biotin system. First (in case of a precomplexing detection system), the test article is incubated with the secondary biotinylated anti-human IgG and developed into immune complex. The immune complex at the final concentrations of 2 and 10 μg/mL of test article is added onto tissue sections on object glass and then the tissue sections were reacted for 30 minutes with a avidin-biotin-peroxidase kit. Subsequently, DAB (3,3'-diaminobenzidine), a substrate for the peroxidase reaction, was applied for 4 minutes for tissue staining. Antigen-Sepharose beads are used as positive control tissue sections.

Any specific staining is judged to be either an expected (e.g., consistent with antigen expression) or unexpected reactivity based upon known expression of the target antigen in question. Any staining judged specific is scored for intensity and frequency. Antigen or serum competition or blocking studies can assist further in determining whether observed staining is specific or nonspecific.

If two selected antibodies are found to meet the selection criteria—appropriate tissue staining, matching staining between human and toxicology animal specific tissue—they can be selected for DVD-Ig generation.

The tissue cross-reactivity study has to be repeated with the final DVD-Ig construct, but while these studies follow the same protocol as outline herein, they are more complex to evaluate because any binding can come from any of the two parent antibodies, and any unexplained binding needs to be confirmed with complex antigen competition studies.

It is readily apparent that the complex undertaking of tissue cross-reactivity studies with a multispecific molecule like a DVD-Ig is greatly simplified if the two parental antibodies are selected for: (1) lack of unexpected tissue cross-reactivity findings and (2) appropriate similarity of tissue cross-reactivity findings between the corresponding human and toxicology animal species tissues.

B.12. Specificity and Selectivity

To generate a DVD-Ig molecule with desired specificity and selectivity, one needs to generate and select parent mAbs with the similarly desired specificity and selectivity profile.

Binding studies for specificity and selectivity with a DVD-Ig can be complex due to the four or more binding sites, two each for each antigen. Briefly, binding studies using ELISA, BIAcore, KinExA, or other interaction studies with a DVD-Ig need to monitor the binding of one, two, or more antigens to the DVD-Ig molecule. While BIAcore technology can resolve the sequential, independent binding of multiple antigens, more traditional methods including ELISA or more modern techniques like KinExA cannot. Therefore careful characterization of each parent antibody is critical. After each individual antibody has been characterized for specificity, confirmation of specificity retention of the individual binding sites in the DVD-Ig molecule is greatly simplified.

It is readily apparent that the complex undertaking of determining the specificity of a DVD-Ig is greatly simplified if the two parental antibodies are selected for specificity prior to being combined into a DVD-Ig.

Antigen-antibody interaction studies can take many forms, including many classical protein protein interaction studies, including ELISA (enzyme linked immunosorbent assay), mass spectrometry, chemical cross linking, SEC with light scattering, equilibrium dialysis, gel permeation, ultrafiltration, gel chromatography, large-zone analytical SEC, micro-preparative ultracentrifugation (sedimentation equilibrium), spectroscopic methods, titration microcalorimetry, sedimentation equilibrium (in analytical ultracentrifuge), sedimentation velocity (in analytical centrifuge), surface plasmon resonance (including BIAcore). Relevant references include "Current Protocols in Protein Science," John E. Coligan, Ben M. Dunn, David W. Speicher, Paul T, Wingfield (eds.) Volume 3, chapters 19 and 20, published by John Wiley & Sons Inc., and references included therein and "Current Protocols in Immunology," John E. Coligan, Barbara E. Bierer, David H. Margulies, Ethan M. Shevach, Warren Strober (eds.) published by John Wiley & Sons Inc and relevant references included therein.

Cytokine Release in Whole Blood:

The interaction of mAb with human blood cells can be investigated by a cytokine release assay (Wing, M. G., *Therapeutic Immunology* (1995), 2(4): 183-190; "Current Protocols in Pharmacology," S. J. Enna, Michael Williams, John W. Ferkany, Terry Kenakin, Paul Moser, (eds.) published by John Wiley & Sons Inc; Madhusudan, S., *Clinical Cancer Research* (2004), 10(19): 6528-6534; Cox, *J. Methods* (2006), 38(4): 274-282; Choi, I., *Eur. J. Immunol.*, (2001), 31(1): 94-106). Briefly, various concentrations of mAb are incubated with human whole blood for 24 hours. The concentration tested should cover a wide range including final concentrations mimicking typical blood levels in patients (including but not limited to 100 ng/ml-100 µg/ml). Following the incubation, supernatants and cell lysates are analyzed for the presence of IL-1Rα, TNF-α, IL-1b, IL-6 and IL-8. Cytokine concentration profiles generated for mAb are compared to profiles produced by a negative human IgG control and a positive LPS or PHA control. The cytokine profile displayed by mAb from both cell supernatants and cell lysates are compared to that using control human IgG. In an embodiment, the monoclonal antibody does not interact with human blood cells to spontaneously release inflammatory cytokines.

Cytokine release studies for a DVD-Ig are complex due to the four or more binding sites, two each for each antigen. Briefly, cytokine release studies as described herein measure the effect of the whole DVD-Ig molecule on whole blood or other cell systems, but cannot resolve which portion of the molecule causes cytokine release. Once cytokine release has been detected, the purity of the DVD-Ig preparation has to be ascertained, because some co-purifying cellular components can cause cytokine release on their own. If purity is not the issue, fragmentation of DVD-Ig (including but not limited to removal of Fc portion, separation of binding sites etc.), binding site mutagenesis or other methods may need to be employed to deconvolute any observations. It is readily apparent that this complex undertaking is greatly simplified if the two parental antibodies are selected for lack of cytokine release prior to being combined into a DVD-Ig.

B.13. Cross Reactivity to Other Species for Toxicological Studies

In an embodiment, the individual antibodies selected with sufficient cross-reactivity to appropriate tox species, for example, cynomolgus monkey. Parental antibodies need to bind to orthologous species target (i.e. cynomolgus monkey) and elicit appropriate response (modulation, neutralization, activation). In an embodiment, the cross-reactivity (affinity/potency) to orthologous species target should be within 10-fold of the human target. In practice, the parental antibodies are evaluated for multiple species, including mouse, rat, dog, monkey (and other non-human primates), as well as disease model species (i.e. sheep for asthma model). The acceptable cross-reactivity to tox species from the parental monoclonal antibodies allows future toxicology studies of DVD-Ig in the same species. For that reason, the two parental monoclonal antibodies should have acceptable cross-reactivity for a common tox species therefore allowing toxicology studies of DVD-Ig in the same species.

Parent mAbs may be selected from various mAbs capable of binding specific targets and well known in the art. These include, but are not limited to anti-IL-17, anti-IL-17F, anti-TNF antibody (U.S. Pat. No. 6,258,562), anti-IL-12 and/or anti-IL-12p40 antibody (U.S. Pat. No. 6,914,128); anti-IL-18 antibody (US patent application publication No. 2005/0147610 A1), anti-C5, anti-CBL, anti-CD147, anti-gp120, anti-VLA-4, anti-CD11a, anti-CD18, anti-VEGF, anti-CD40L, anti CD-40 (e.g., see WO2007124299) anti-Id, anti-ICAM-1, anti-CXCL13, anti-CD2, anti-EGFR, anti-TGF-beta 2, anti-HGF, anti-cMet, anti DLL-4, anti-NPR1, anti-PLGF, anti-ErbB3, anti-E-selectin, anti-Fact VII, anti-Her2/neu, anti-F gp, anti-CD11/18, anti-CD14, anti-ICAM-3, anti-RON, anti CD-19, anti-CD80 (e.g., see PCT Publication No. WO 2003/039486), anti-CD4, anti-CD3, anti-CD23, anti-beta2-integrin, anti-alpha4beta7, anti-CD52, anti-HLA DR, anti-CD22 (see, e.g., U.S. Pat. No. 5,789,554), anti-CD20, anti-MIF, anti-CD64 (FcR), anti-TCR alpha beta, anti-CD2, anti-Hep B, anti-CA 125, anti-EpCAM, anti-gp120, anti-CMV, anti-gpIIbIIIa, anti-IgE, anti-CD25, anti-CD33, anti-HLA, anti-IGF1,2, anti IGFR, anti-VNRintegrin, anti-IL-1alpha, anti-IL-1beta, anti-IL-1 receptor, anti-IL-2 receptor, anti-IL-4, anti-IL-4 receptor, anti-IL5, anti-IL-5 receptor, anti-IL-6, anti-IL-6R, RANKL, NGF, DKK, alphaVbeta3, anti-IL-8, anti-IL-9, anti-IL-13, anti-IL-13 receptor, and anti-IL-23; IL-23p19; (see, Presta, "Selection, design, and engineering of therapeutic antibodies," *J. Allergy Clin. Immunol.*, 116: 731-736 (2005) and at worldwide website http://www-.path.cam.ac.uk/~mrc7/humanisation/antibodies.html).

Parent mAbs may also be selected from various therapeutic antibodies approved for use, in clinical trials, or in development for clinical use. Such therapeutic antibodies include, but are not limited to, rituximab (Rituxan®, IDEC/Genentech/Roche) (see for example U.S. Pat. No. 5,736,137), a chimeric anti-CD20 antibody approved to treat Non-Hodgkin's lymphoma; HuMax-CD20, an anti-CD20 antibody currently being developed by Genmab, an anti-CD20 antibody described in U.S. Pat. No. 5,500,362, AME-133 (Applied Molecular Evolution), hA20 (Immunomedics, Inc.), HumaLYM (Intracel), and PRO70769 (PCT/US2003/040426, entitled "Immunoglobulin Variants and Uses Thereof"), trastuzumab (Herceptin®, Genentech) (see for example U.S. Pat. No. 5,677,171), a humanized anti-Her2/neu antibody approved to treat breast cancer; pertuzumab (rhuMab-2C4, Omnitarg®), currently being developed by Genentech; an anti-Her2 antibody described in U.S. Pat. No. 4,753,894; cetuximab (Erbitux®, Imclone) (U.S. Pat. No. 4,943,533; PCT WO 96/40210), a chimeric anti-EGFR antibody in clinical trials for a variety of cancers; ABX-EGF (U.S. Pat. No. 6,235,883), currently being developed by Abgenix-Immunex-Amgen; HuMax-EGFr (U.S. Ser. No. 10/172,317), currently being developed by Genmab; 425, EMD55900, EMD62000, and EMD72000 (Merck KGaA) (U.S. Pat. No. 5,558,864; Murthy et al. 1987, Arch Biochem Biophys. 252(2):549-60; Rodeck et al., 1987, J Cell Biochem. 35(4):315-20; Kettleborough et al., 1991, Protein Eng. 4(7):773-83); ICR62 (Institute of Cancer Research) (PCT WO 95/20045; Modjtahedi et al., 1993, J. Cell Biophys. 1993, 22(1-3):129-46; Modjtahedi et al., 1993, Br J Cancer. 1993, 67(2):247-53; Modjtahedi et al, 1996, Br J Cancer, 73(2):228-35; Modjtahedi et al, 2003, Int J Cancer, 105(2):273-80); TheraCIM hR3 (YM Biosciences, Canada and Centro de Immunologia Molecular, Cuba (U.S. Pat. No. 5,891,996; U.S. Pat. No. 6,506,883; Mateo et al, 1997, Immunotechnology, 3(1):71-81); mAb-806 (Ludwig Institute for Cancer Research, Memorial Sloan-Kettering) (Jungbluth et al. 2003, Proc Natl Acad Sci USA. 100(2):639-44); KSB-102 (KS Biomedix); MR1-1 (IVAX, National Cancer Institute) (PCT WO 0162931A2); and SC100 (Scancell) (PCT WO 01/88138); alemtuzumab (Campath®, Millenium), a humanized mAb currently approved for treatment of B-cell chronic lymphocytic leukemia; muromonab-CD3 (Orthoclone OKT3®), an anti-CD3 antibody developed by Ortho Biotech/Johnson & Johnson, ibritumomab tiuxetan (Zevalin®), an anti-CD20 antibody developed by IDEC/Schering AG, gemtuzumab ozogamicin (Mylotarg®), an anti-CD33 (p67 protein) antibody developed by Celltech/Wyeth, alefacept (Amevive®), an anti-LFA-3 Fc fusion developed by Biogen), abciximab (ReoPro®), developed by Centocor/Lilly, basiliximab (Simulect®), developed by Novartis, palivizumab (Synagis®), developed by Medimmune, infliximab (Remicade®), an anti-TNFalpha antibody developed by Centocor, adalimumab (Humira®), an anti-TNFalpha antibody developed by Abbott, Humicade®, an anti-TNFalpha antibody developed by Celltech, golimumab (CNTO-148), a fully human TNF antibody developed by Centocor, etanercept (Enbrel®), an p75 TNF receptor Fc fusion developed by Immunex/Amgen, lenercept, an p55TNF receptor Fc fusion previously developed by Roche, ABX-CBL, an anti-CD147 antibody being developed by Abgenix, ABX-IL8, an anti-IL8 antibody being developed by Abgenix, ABX-MA1, an anti-MUC18 antibody being developed by Abgenix, Pemtumomab (R1549, 90Y-muHMFG1), an anti-MUC1 in development by Antisoma, Therex (R1550), an anti-MUC1 antibody being developed by Antisoma, AngioMab (AS1405), being developed by Antisoma, HuBC-1, being developed by Antisoma, Thioplatin (AS1407) being developed by Antisoma, Antegren® (natalizumab), an anti-alpha-4-beta-1 (VLA-4) and alpha-4-beta-7 antibody being developed by Biogen, VLA-1 mAb, an anti-VLA-1 integrin antibody being developed by Biogen, LTBR mAb, an anti-lymphotoxin beta receptor (LTBR) antibody being developed by Biogen, CAT-152, an anti-TGF-β2 antibody being developed by Cambridge Antibody Technology, ABT 874 (J695), an anti-IL-12 p40 antibody being developed by Abbott, CAT-192, an anti-TGFβ1 antibody being developed by Cambridge Antibody Technology and Genzyme, CAT-213, an anti-Eotaxin1 antibody being developed by Cambridge Antibody Technology, LymphoStat-B® an anti-Blys antibody being developed by Cambridge Antibody Technology and Human Genome Sciences Inc., TRAIL-R1 mAb, an anti-TRAIL-R1 antibody being developed by Cambridge Antibody Technology and Human Genome Sciences, Inc., Avastin® bevacizumab, rhuMAb-VEGF), an anti-VEGF antibody being developed by Genentech, an anti-HER receptor family antibody being developed by Genentech, Anti-Tissue Factor (ATF), an anti-Tissue Factor antibody being developed by Genentech, Xolair® (Omalizumab), an anti-IgE antibody being developed by Genentech, Raptiva® (Efalizumab), an anti-CD11a antibody being developed by Genentech and Xoma, MLN-02 Antibody (formerly LDP-02), being developed by Genentech and Millenium Pharmaceuticals, HuMax CD4, an anti-CD4 antibody being developed by Genmab, HuMax-IL15, an anti-IL15 antibody being developed by Genmab and Amgen, HuMax-Inflam, being developed by Genmab and Medarex, HuMax-Cancer, an anti-Heparanase I antibody being developed by Genmab and Medarex and Oxford GcoSciences, HuMax-Lymphoma, being developed by Genmab and Amgen, HuMax-TAC, being developed by Genmab, IDEC-131, and anti-CD40L antibody being developed by IDEC Pharmaceuticals, IDEC-151 (Clenoliximab), an anti-CD4 antibody being developed by IDEC Pharmaceuticals, IDEC-114, an anti-CD80 antibody being developed by IDEC Pharmaceuticals, IDEC-152, an anti-CD23 being developed by IDEC Pharmaceuticals, anti-macrophage migration factor (MIF) antibodies being developed by IDEC Pharmaceuticals, BEC2, an anti-idiotypic antibody being developed by Imclone, IMC-1C11, an anti-KDR antibody being developed by Imclone, DC101, an anti-flk-1 antibody being developed by Imclone, anti-VE cadherin antibodies being developed by Imclone, CEA-Cide® (labetuzumab), an anti-carcinoembryonic antigen (CEA) antibody being developed by Immunomedics, LymphoCide® (Epratuzumab), an anti-CD22 antibody being developed by Immunomedics, AFP-Cide, being developed by Immunomedics, MyelomaCide, being developed by Immunomedics, LkoCide, being developed by Immunomedics, ProstaCide, being developed by Immunomedics, MDX-010, an anti-CTLA4 antibody being developed by Medarex, MDX-060, an anti-CD30 antibody being developed by Medarex, MDX-070 being developed by Medarex, MDX-018 being developed by Medarex, Osidem® (IDM-1), and anti-Her2 antibody being developed by Medarex and Immuno-Designed Molecules, HuMax®-CD4, an anti-CD4 antibody being developed by Medarex and Genmab, HuMax-IL15, an anti-IL15 antibody being developed by Medarex and Genmab, CNTO 148, an anti-TNFα antibody being developed by Medarex and Centocor/Johnson & Johnson, CNTO 1275, an anti-cytokine antibody being developed by Centocor/Johnson & Johnson, MOR101 and MOR102, anti-intercellular adhesion molecule-1 (ICAM-1) (CD54) antibodies being developed by MorphoSys, MOR201, an anti-fibroblast growth factor receptor 3 (FGFR-3) antibody being developed by MorphoSys, Nuvion® (visilizumab), an anti-CD3 antibody being developed by Protein Design Labs, HuZAF®, an anti-gamma interferon antibody being developed by Protein Design Labs, Anti-α 5β1 Integrin, being developed by Protein Design Labs, anti-IL-12, being developed by Protein Design Labs, ING-1, an anti-EpCAM antibody being developed by Xoma, Xolair® (Omalizumab) a humanized anti-IgE antibody developed by Genentech and Novartis, and MLN01, an anti-Beta2 integrin antibody being developed by Xoma. In another embodiment, the therapeutics include KRN330 (Kirin); huA33 antibody (A33, Ludwig Institute for Cancer Research); CNTO 95 (alpha V integrins, Centocor); MEDI-522 (alpha Vβ3 integrin, Medimmune); volociximab (alpha Vβ1 integrin, Biogen/PDL); Human mAb 216 (B cell glycosolated epitope, NCI); BiTE MT103 (bispecific CD19×CD3, Medimmune); 4G7xH22 (Bispecific BcellxFcgammaR1, Medarex/Merck KGa); rM28 (Bispecific CD28×MAPG, US Patent No. EP1444268); MDX447 (EMD 82633) (Bispecific CD64× EGFR, Medarex); Catumaxomab (removab) (Bispecific EpCAM×anti-CD3, Trion/Fres); Ertumaxomab (bispecific HER2/CD3, Fresenius Biotech); oregovomab (OvaRex) (CA-125, ViRexx); Rencarex® (WX G250) (carbonic anhydrase IX, Wilex); CNTO 888 (CCL2, Centocor); TRC105 (CD105 (endoglin), Tracon); BMS-663513 (CD137 agonist, Brystol Myers Squibb); MDX-1342 (CD19, Medarex); Siplizumab (MEDI-507) (CD2, Medimmune); Ofatumumab (Humax-CD20) (CD20, Genmab); Rituximab (Rituxan) (CD20, Genentech); veltuzumab (hA20) (CD20, Immunomedics); Epratuzumab (CD22, Amgen); lumiliximab (IDEC 152) (CD23, Biogen); muromonab-CD3 (CD3, Ortho); HuM291 (CD3 fc receptor, PDL Biopharma); HeFi-1, CD30, NCI); MDX-060 (CD30, Medarex); MDX-1401 (CD30, Medarex); SGN-30 (CD30, Seattle Genentics); SGN-33 (Lintuzumab) (CD33, Seattle Genentics); Zanolimumab (HuMax-CD4) (CD4, Genmab); HCD122 (CD40, Novartis); SGN-40 (CD40, Seattle Genentics); Campath1h (Alemtuzumab) (CD52, Genzyme); MDX-1411 (CD70, Medarex); hLL1 (EPB-1) (CD74.38, Immunomedics); Galiximab (IDEC-144) (CD80, Biogen); MT293 (TRC093/D93) (cleaved collagen, Tracon); HuLuc63 (CS1, PDL Pharma); ipilimumab (MDX-010) (CTLA4, Brystol Myers Squibb); Tremelimumab (Ticilimumab, CP-675,2) (CTLA4, Pfizer); HGS-ETR1 (Mapatumumab) (DR4TRAIL-R1 agonist, Human Genome Science/Glaxo Smith Kline); AMG-655 (DR5, Amgen); Apomab (DR5, Genentech); CS-1008 (DR5, Daiichi Sankyo); HGS-ETR2 (lexatumumab) (DR5TRAIL-R2 agonist, HGS); Cetuximab (Erbitux) (EGFR, Imclone); IMC-11F8, (EGFR, Imclone); Nimotuzumab (EGFR, YM Bio); Panitumumab (Vectabix) (EGFR, Amgen); Zalutumumab (HuMaxEGFr) (EGFR, Genmab); CDX-110 (EGFRvIII, AVANT Immunotherapeutics); adecatumumab (MT201) (Epcam, Merck); edrecolomab (Panorex, 17-1A) (Epcam, Glaxo/Centocor); MORAb-003 (folate receptor a, Morphotech); KW-2871 (ganglioside GD3, Kyowa); MORAb-009 (GP-9, Morphotech); CDX-1307 (MDX-1307) (hCGb, Celldex); Trastuzumab (Herceptin) (HER2, Celldex); Pertuzumab (rhuMAb 2C4) (HER2, DI), Genentech); apolizumab (HLA-DR beta chain, PDL Pharma); AMG-479 (IGF-1R, Amgen); anti-IGF-1R R1507 (IGF1-R, Roche); CP 751871 (IGF1-R, Pfizer); IMC-A12 (IGF1-R, Imclone); BIIB022 (IGF-1R, Biogen); Mik-beta-1 (IL-2Rb (CD122), Hoffman LaRoche); CNTO 328 (IL6, Centocor); Anti-KIR (1-7F9) (Killer cell Ig-like Receptor (KIR), Novo); Hu3S193 (Lewis (y), Wyeth, Ludwig Institute of Cancer Research); hCBE-11 (LTβR, Biogen); HuHMFG1 (MUC1, Antisoma/NCI); RAV12 (N-linked carbohydrate epitope, Raven); CAL (parathyroid hormone-related protein (PTH-rP), University of California); CT-011 (PD1, CureTech); MDX-1106 (ono-4538) (PD1, Medarex/Ono); MAb CT-011 (PD1, Curetech); IMC-3G3 (PDGFRa, Imclone); bavituximab (phosphatidylserine, Peregrine); huJ591 (PSMA, Cornell Research Foundation); muJ591 (PSMA, Cornell Research Foundation); GC1008 (TGFb (pan) inhibitor (IgG4), Genzyme); Infliximab (Remicade) (TNFa, Centocor); A27.15 (transferrin receptor, Salk Institute, INSERN WO 2005/111082); E2.3 (transferrin receptor, Salk Institute); Bevacizumab (Avastin) (VEGF, Genentech); HuMV833 (VEGF, Tsukuba Research Lab-WO/2000/034337, University of Texas); IMC-18F1 (VEGFR1, Imclone); IMC-1121 (VEGFR2, Imclone).

C. Construction of DVD-Ig™ Binding Proteins

A multivalent multispecific dual variable domain immunoglobulin (DVD-Ig™) binding protein is designed such that two different light chain variable domains (VL) from two different parent monoclonal antibodies are linked in tandem directly or via a short linker by recombinant DNA techniques, followed by the light chain constant domain. Similarly, the heavy chain comprises two different heavy chain variable domains (VH) linked in tandem, followed by the constant domain CH1 and Fc region.

The variable domains can be obtained using recombinant DNA techniques from a parent antibody generated by any one of the methods described herein. In an embodiment, the variable domain is a murine heavy or light chain variable domain. In another embodiment, the variable domain is a CDR-grafted or a humanized variable heavy or light chain domain. In an embodiment, the variable domain is a human heavy or light chain variable domain.

In one embodiment, the first and second variable domains are linked directly to each other using recombinant DNA techniques. In another embodiment the variable domains are linked via a linker sequence. In an embodiment, two variable domains are linked. Three or more variable domains may also be linked directly or via a linker sequence. The variable domains may bind the same antigen or may bind different antigens. DVD-Ig molecules of the invention may include one immunoglobulin variable domain and one non-immunoglobulin variable domain such as ligand binding domain of a receptor, active domain of an enzyme. DVD-Ig molecules may also comprise two or more non-Ig domains.

The linker sequence may be a single amino acid or a polypeptide sequence. In an embodiment, the linker sequences are selected from the group consisting of GGGGSG (SEQ ID NO:887), GGSGG (SEQ ID NO:888), GGGGSGGGGS (SEQ ID NO:889), GGSGGGGSGS (SEQ ID NO:890), GGSGGGGSGGGGS (SEQ ID NO:891), GGGGSGGGGSGGGG (SEQ ID NO:892), GGGGSGGGGSGGGGS (SEQ ID NO:893), ASTKGP (SEQ ID NO:894), ASTKGPSVFPLAP (SEQ ID NO:895), TVAAP (SEQ ID NO:896), TVAAPSVFIFPP (SEQ ID NO:897), AKTTPKLEEGEFSEAR (SEQ ID NO:898), AKTTPKLEEGEFSEARV (SEQ ID NO:899), AKTTP-KLGG (SEQ ID NO:900), SAKTTPKLGG (SEQ ID NO:901), SAKTTP (SEQ ID NO:902), RADAAP (SEQ ID NO:903), RADAAPTVS (SEQ ID NO:904), RADAAAAG-GPGS (SEQ ID NO:905), RADAAAAGGGGSGGGGSGGGGSGGGGS (SEQ ID NO:906), SAKTTPKLEEGEFSEARV (SEQ ID NO:907), ADAAP (SEQ ID NO:908), ADAAPTVSIFPP (SEQ ID NO:909), QPKAAP (SEQ ID NO:910), QPKAAPSVTLFPP (SEQ ID NO:911), AKTTPP (SEQ ID NO:912), AKTTPPS-VTPLAP (SEQ ID NO:913), AKTTAP (SEQ ID NO:914), AKTTAPSVYPLAP (SEQ ID NO:915), GENKVEYAPAL-MALS (SEQ ID NO:916), GPAKELTPLKEAKVS (SEQ ID NO:917), and GHEAAAVMQVQYPAS (SEQ ID NO:918). The choice of linker sequences is based on crystal structure analysis of several Fab molecules. There is a natural flexible linkage between the variable domain and the CH1/CL constant domain in Fab or antibody molecular structure. This natural linkage comprises approximately 10-12 amino acid residues, contributed by 4-6 residues from C-terminus of V domain and 4-6 residues from the N-terminus of CL/CH1 domain. DVD-Igs described herein can be generated using N-terminal 5-6 amino acid residues, or 11-12 amino acid residues, of CL or CH1 as linker in light chain and heavy chain of DVD-Ig, respectively. The N-terminal residues of CL or CH1 domains, particularly the first 5-6 amino acid residues, adopt a loop conformation without strong secondary structures, and therefore can act as flexible linkers between the two variable domains. The N-terminal residues of CL or CH1 domains are natural extension of the variable domains, as they are part of the Ig sequences, and therefore minimize to a large extent any immunogenicity potentially arising from the linkers and junctions.

Other linker sequences may include any sequence of any length of CL/CH1 domain but not all residues of CL/CH1 domain; for example the first 5-12 amino acid residues of the CL/CH1 domains; the light chain linkers can be from Cκ or Cλ; and the heavy chain linkers can be derived from CH1 of any isotypes, including Cγ1, Cγ2, Cγ3, Cγ4, Cα1, Cα2, Cδ, Cε, and Cµ. Linker sequences may also be derived from other proteins such as Ig-like proteins, (e.g., TCR, FcR, KIR); G/S based sequences; hinge region-derived sequences; and other natural sequences from other proteins.

In an embodiment a constant domain is linked to the two linked variable domains using recombinant DNA techniques. In an embodiment, a sequence comprising tandemly linked heavy chain variable domains is linked to a heavy chain constant domain and a sequence comprising tandemly linked light chain variable domains is linked to a light chain constant domain. In an embodiment, the constant domains are human heavy chain constant domain and human light chain constant domain, respectively. In an embodiment, the DVD heavy chain is further linked to an Fc region. The Fc region may be a native sequence Fc region, or a variant Fc region. In another embodiment, the Fc region is a human Fc region. In another embodiment the Fc region includes Fc region from IgG1, IgG2, IgG3, IgG4, IgA, IgM, IgE, or IgD.

In a most preferred embodiment, two heavy chain DVD polypeptides and two light chain DVD polypeptides are combined to form a DVD-Ig molecule. Detailed description of specific DVD-Ig molecules capable of binding specific target antigens, such as IL-17, and methods of making the same are provided in the Examples section below.

D. Production of DVD-Ig Binding Proteins

DVD-Ig binding proteins of the present invention may be produced by any of a number of techniques known in the art including, for example, expression from host cells, wherein expression vector(s) encoding the DVD-Ig heavy and DVD-Ig light chains is (are) transfected into a host cell by standard techniques. The various forms of the term "transfection" are intended to encompass a wide variety of techniques commonly used for the introduction of exogenous DNA into a prokaryotic or eukaryotic host cell, e.g., electroporation, calcium-phosphate precipitation, DEAE-dextran transfection and the like. Although it is possible to express the DVD-Ig proteins of the invention in either prokaryotic or eukaryotic host cells, DVD-Ig proteins are expressed in eukaryotic cells, for example, mammalian host cells, because such eukaryotic cells (and in particular mammalian cells) are more likely than prokaryotic cells to assemble and secrete a properly folded and immunologically active DVD-Ig protein.

Exemplary mammalian host cells for expressing the recombinant antibodies of the invention include Chinese Hamster Ovary (CHO cells) (including dhfr-CHO cells, described in Urlaub and Chasin, (1980) *Proc. Natl. Acad. Sci. USA*, 77: 4216-4220, used with a DHFR selectable marker, e.g., as described in R. J. Kaufman and P. A. Sharp (1982) *Mol. Biol.*, 159: 601-621), NS0 myeloma cells, COS cells, SP2 and PER.C6 cells. When recombinant expression vectors encoding DVD-Ig proteins are introduced into mammalian host cells, the DVD-Ig proteins are produced by culturing the host cells for a period of time sufficient to allow for expression of the DVD-Ig proteins in the host cells or secretion of the DVD proteins into the culture medium in which the host cells are grown. DVD-Ig proteins can be recovered from the culture medium using standard protein purification methods.

In an exemplary system for recombinant expression of DVD-Ig proteins of the invention, a recombinant expression vector encoding both the DVD-Ig heavy chain and the DVD-Ig light chain is introduced into dhfr-CHO cells by calcium phosphate-mediated transfection. Within the recombinant expression vector, the DVD-Ig heavy and light chain genes are each operatively linked to CMV enhancer/AdMLP promoter regulatory elements to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the DVD-Ig heavy and light chains and intact DVD-Ig protein is recovered from the culture medium. Standard molecular biology techniques are used to prepare the recombinant expression vector, transfect the host cells, select for transformants, culture the host cells and recover the DVD-Ig protein from the culture medium. Still further the invention provides a method of synthesizing a DVD-Ig protein of the invention by culturing a host cell of the invention in a suitable culture medium until a DVD-Ig protein of the invention is synthesized. The method can further comprise isolating the DVD-Ig protein from the culture medium.

An important feature of DVD-Ig is that it can be produced and purified in a similar way as a conventional antibody. The production of DVD-Ig results in a homogeneous, single major product with desired dual-specific activity, without any sequence modification of the constant region or chemical modifications of any kind. Other previously described methods to generate "bi-specific", "multi-specific", and "multi-specific multivalent" full length binding proteins do not lead to a single primary product but instead lead to the intracellular or secreted production of a mixture of assembled inactive, mono-specific, multi-specific, multivalent, full length binding proteins, and multivalent full length binding proteins with combination of different binding sites. As an example, based on the design described by Miller and Presta (PCT Publication No. WO 2001/077342(A1), there are 16 possible combinations of heavy and light chains. Consequently only 6.25% of protein is likely to be in the desired active form, and not as a single major product or single primary product compared to the other 15 possible combinations. Separation of the desired, fully active forms of the protein from inactive and partially active forms of the protein using standard chromatography techniques, typically used in large scale manufacturing, is yet to be demonstrated.

Surprisingly, the design of the "dual-specific multivalent full length binding proteins" of the present invention leads to a dual variable domain light chain and a dual variable domain heavy chain which assemble primarily to the desired "dual-specific multivalent full length binding proteins".

At least 50%, at least 75%, and at least 90% of the assembled, and expressed DVD-Ig molecules are the desired dual-specific tetravalent protein. This aspect of the invention particularly enhances the commercial utility of the invention.

Therefore, the present invention includes a method to express a dual variable domain light chain and a dual variable domain heavy chain in a single cell leading to a single primary product of a "dual-specific tetravalent full length binding protein".

The present invention provides a methods of expressing a dual variable domain light chain and a dual variable domain heavy chain in a single cell leading to a "primary product" of a "dual-specific, tetravalent, full length binding protein", where the "primary product" is more than 50% of all assembled protein, comprising a dual variable domain light chain and a dual variable domain heavy chain.

The present invention provides methods of expressing a dual variable domain light chain and a dual variable domain heavy chain in a single cell leading to a single "primary product" of a "dual-specific, tetravalent, full length binding protein", where the "primary product" is more than 75% of all assembled protein, comprising a dual variable domain light chain and a dual variable domain heavy chain.

The present invention provides methods of expressing a dual variable domain light chain and a dual variable domain heavy chain in a single cell leading to a single "primary product" of a "dual-specific tetravalent full length binding protein", where the "primary product" is more than 90% of all assembled protein, comprising a dual variable domain light chain and a dual variable domain heavy chain.

6. Production of IL-17 Binding Proteins and Binding Protein-Producing Cell Lines Preferably, LI-17 binding proteins, including anti-IL-17 antibodies, of the present invention exhibit a high capacity to reduce or to neutralize IL-17 activity, e.g., as assessed by any one of several in vitro and in vivo assays known in the art. Preferably, IL-17 binding proteins of the present invention, also exhibit a high capacity to reduce or to neutralize IL-17 activity In preferred embodiments, a binding protein, or antigen-binding portion thereof, binds human IL-17, wherein the binding protein, or antigen-binding portion thereof, dissociates from human IL-17 with a $k_{off}$ rate constant of about $0.1 s^{-1}$ or less, as determined by surface plasmon resonance, or which inhibits human IL-17A and/or human IL-17F activity with an $IC_{50}$ of about $1 \times 10^{-6}$M or less. Alternatively, the binding protein, or an antigen-binding portion thereof, may dissociate from human IL-17 with a $k_{off}$ rate constant of about $1 \times 10^{-2} s^{-1}$ or less, as determined by surface plasmon resonance, or may inhibit human IL-17A and/or human IL-17F activity with an $IC_{50}$ of about $1 \times 10^{-7}$M or less. Alternatively, the binding protein, or an antigen-binding portion thereof, may dissociate from human IL-17 with a $k_{off}$ rate constant of about $1 \times 10^{-3} s^{-1}$ or less, as determined by surface plasmon resonance, or may inhibit human IL-17A and/or human IL-17F with an $IC_{50}$ of about $1 \times 10^{-8}$M or less. Alternatively, the binding protein, or an antigen-binding portion thereof, may dissociate from human IL-17 with a $k_{off}$ rate constant of about $1 \times 10^{4} s^{-1}$ or less, as determined by surface plasmon resonance, or may inhibit human IL-17A and/or human IL-17F activity with an $IC_{50}$ of about $1 \times 10^{-9}$M or less. Alternatively, the binding protein, or an antigen-binding portion thereof, may dissociate from human IL-17 with a $k_{off}$ rate constant of about $1 \times 10^{-5} s^{-1}$ or less, as determined by surface plasmon resonance, or may inhibit human IL-17A and/or human IL-17F activity with an $IC_{50}$ of about $1 \times 10^{-10}$ M or less. Alternatively, the binding protein, or an antigen-binding portion thereof, may dissociate from human IL-17 with a $k_{off}$ rate constant of about $1 \times 10^{-5} s^{-1}$ or less, as determined by surface plasmon resonance, or may inhibit human IL-17A and/or human IL-17F activity with an $IC_{50}$ of about $1 \times 10^{-11}$ M or less.

In certain embodiments, the binding protein comprises a heavy chain constant region, such as an IgG1, IgG2, IgG3, IgG4, IgA, IgE, IgM or IgD constant region. Preferably, the heavy chain constant region is an IgG1 heavy chain constant region or an IgG4 heavy chain constant region. Furthermore, the antibody can comprise a light chain constant region, either a kappa light chain constant region or a lambda light chain constant region. Preferably, the antibody comprises a kappa light chain constant region. Alternatively, the antibody portion can be, for example, a Fab fragment or a single chain Fv fragment.

Replacements of amino acid residues in the Fc portion to alter antibody effector function are known in the art (Winter et al., U.S. Pat. Nos. 5,648,260 and 5,624,821). The Fc portion of an antibody mediates several important effector functions e.g. cytokine induction, ADCC, phagocytosis, complement dependent cytotoxicity (CDC) and half-life/clearance rate of antibody and antigen-antibody complexes. In some cases these effector functions are desirable for therapeutic antibody but in other cases might be unnecessary or even deleterious, depending on the therapeutic objectives. Certain human IgG isotypes, particularly IgG1 and IgG3, mediate ADCC and CDC via binding to FcγRs and complement C1q, respectively. Neonatal Fc receptors (FcRn) are the critical components determining the circulating half-life of antibodies. In still another embodiment at least one amino acid residue is replaced in the constant region of the antibody, for example the Fc region of the antibody, such that effector functions of the antibody are altered.

One embodiment provides a labeled binding protein wherein an antibody or antibody portion of the invention is derivatized or linked to another functional molecule (e.g., another peptide or protein). For example, a labeled binding protein of the invention can be derived by functionally linking an antibody or antibody portion of the invention (by chemical coupling, genetic fusion, noncovalent association or otherwise) to one or more other molecular entities, such as another antibody (e.g., a bispecific antibody or a diabody), a detectable agent, a cytotoxic agent, a pharmaceutical agent, and/or a protein or peptide that can mediate associate of the antibody or antibody portion with another molecule (such as a streptavidin core region or a polyhistidine tag).

Useful detectable agents with which a binding protein, such as an antibody or antibody portion of the invention may be derivatized include fluorescent compounds. Exemplary fluorescent detectable agents include fluorescein, fluorescein isothiocyanate, rhodamine, 5-dimethylamine-1-napthalene-sulfonyl chloride, phycoerythrin and the like. An antibody may also be derivatized with detectable enzymes, such as alkaline phosphatase, horseradish peroxidase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody may also be derivatized with biotin, and detected through indirect measurement of avidin or streptavidin binding.

Another embodiment of the invention provides a crystallized binding protein. Preferably the invention relates to crystals of whole anti-IL-17 antibodies and fragments thereof as disclosed herein, and formulations and compositions comprising such crystals. In one embodiment the crystallized binding protein has a greater half-life in vivo than the soluble counterpart of the binding protein. In another embodiment the binding protein retains biological activity after crystallization.

Crystallized binding protein of the invention may be produced according methods known in the art and as disclosed in PCT Publication No. WO 02072636, incorporated herein by reference.

Another embodiment of the invention provides a glycosylated binding protein wherein the antibody or antigen-binding portion thereof comprises one or more carbohydrate residues. Nascent in vivo protein production may undergo further processing, known as post-translational modification. In particular, sugar (glycosyl) residues may be added enzymatically, a process known as glycosylation. The resulting proteins bearing covalently linked oligosaccharide side chains are known as glycosylated proteins or glycoproteins.

Naturally occurring antibodies are glycoproteins with one or more carbohydrate residues in the Fc domain, as well as the variable domain. Carbohydrate residues in the Fc domain have important effect on the effector function of the Fc domain, with minimal effect on antigen binding or half-life of the antibody (R. Jefferis, *Biotechnol. Prog.*, 21: 11-16 (2005)). In contrast, glycosylation of the variable domain may have an effect on the antigen binding activity of the antibody. Glycosylation in the variable domain may have a negative effect on antibody binding affinity, likely due to steric hindrance (Co, M. S., et al., *Mol. Immunol.*, 30: 1361-1367 (1993)), or result in increased affinity for the antigen (Wallick, S. C., et al., *Exp. Med.*, 168:1099-1109 (1988); Wright, A., et al., *EMBO J.*, 10: 2717-2723 (1991)).

One aspect of the present invention is directed to generating glycosylation site mutants in which the O- or N-linked glycosylation site of the binding protein has been mutated. One skilled in the art can generate such mutants using standard well-known technologies. Glycosylation site mutants that retain the biological activity but have increased or decreased binding activity are another object of the present invention.

In still another embodiment, the glycosylation of the antibody or antigen-binding portion of the invention is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region glycosylation sites to thereby eliminate glycosylation at that site. Such aglycosylation may increase the affinity of the antibody for antigen. Such an approach is described in further detail in PCT Publication WO 2003/016466A2, and U.S. Pat. Nos. 5,714,350 and 6,350,861.

Additionally or alternatively, a modified binding protein of the invention can be made that has an altered type of glycosylation, such as a hypofucosylated antibody having reduced amounts of fucosyl residues (see Kanda, Yutaka et al., Journal of Biotechnology (2007), 130(3), 300-310.) or an antibody having increased bisecting GlcNAc structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation. See, for example, Shields, R. L. et al. (2002) J. Biol. Chem. 277: 26733-26740; Umana et al., "Engineered glycoforms of an antineuroblastoma IgG1 with optimized antibody-dependent cellular cytotoxic activity," *Nat. Biotech.*, 17: 176-180 (1999), as well as, European Patent No: EP 1,176,195; PCT Publication Nos. WO 03/035835 and WO 99/54342.

Protein glycosylation depends on the amino acid sequence of the protein of interest, as well as the host cell in which the protein is expressed. Different organisms may produce different glycosylation enzymes (e.g., glycosyltransferases and glycosidases), and have different substrates (nucleotide sugars) available. Due to such factors, protein glycosylation pattern, and composition of glycosyl residues, may differ depending on the host system in which the particular protein is expressed. Glycosyl residues useful in the invention may include, but are not limited to, glucose, galactose, mannose, fucose, n-acetylglucosamine and sialic acid. Preferably the glycosylated binding protein comprises glycosyl residues such that the glycosylation pattern is human.

It is known to those skilled in the art that differing protein glycosylation may result in differing protein characteristics. For instance, the efficacy of a therapeutic protein produced in a microorganism host, such as yeast, and glycosylated utilizing the yeast endogenous pathway may be reduced compared to that of the same protein expressed in a mammalian cell, such as a CHO cell line. Such glycoproteins may also be immunogenic in humans and show reduced half-life in vivo after administration. Specific receptors in humans and other animals may recognize specific glycosyl residues and promote the rapid clearance of the protein from the bloodstream. Other adverse effects may include changes in protein folding, solubility, susceptibility to proteases, trafficking, transport, compartmentalization, secretion, recognition by other proteins or factors, antigenicity, or allergenicity. Accordingly, a practitioner may prefer a therapeutic protein with a specific composition and pattern of glycosylation, for example glycosylation composition and pattern identical, or at least similar, to that produced in human cells or in the species-specific cells of the intended subject animal.

Expressing glycosylated proteins different from that of a host cell may be achieved by genetically modifying the host cell to express heterologous glycosylation enzymes. Using techniques known in the art a practitioner may generate antibodies or antigen-binding portions thereof exhibiting human protein glycosylation. For example, yeast strains have been genetically modified to express non-naturally occurring glycosylation enzymes such that glycosylated proteins (glycoproteins) produced in these yeast strains exhibit protein glycosylation identical to that of animal cells, especially human cells (US patent application publication Nos. 20040018590 and 20020137134).

In addition to the binding proteins, the present invention is also directed to anti-idiotypic (anti-Id) antibodies specific for such binding proteins of the invention. An anti-Id antibody is an antibody, which recognizes unique determinants generally associated with the antigen-binding region of another antibody. The anti-Id can be prepared by immunizing an animal with the binding protein or a CDR containing region thereof. The immunized animal will recognize, and respond to the idiotypic determinants of the immunizing antibody and produce an anti-Id antibody. It is readily apparent that it may be easier to generate anti-idiotypic antibodies to the two or more parent antibodies incorporated into a DVD-Ig molecule; and confirm binding studies by methods well recognized in the art (e.g., BIAcore, ELISA) to verify that anti-idiotypic antibodies specific for the idiotype of each parent antibody also recognize the idiotype (e.g., antigen binding site) in the context of the DVD-Ig. The anti-idiotypic antibodies specific for each of the two or more antigen binding sites of a DVD-Ig provide ideal reagents to measure DVD-Ig concentrations of a human DVD-Ig in patient serum. For example, DVD-Ig concentration assays can be established using a "sandwich assay ELISA format" with an antibody to a first antigen binding region coated on the solid phase (e.g., BIAcore chip, ELISA plate, etc.), rinsed with rinsing buffer, incubation with a serum sample, another rinsing step, and ultimately incubation with another anti-idiotypic antibody to the other antigen binding site, itself labeled with an enzyme for quantitation of the binding reaction. In an embodiment, for a DVD-Ig with more than two different binding sites, anti-idiotypic antibodies to the two outermost binding sites (most distal and proximal from the constant region) will not only help in determining the DVD-Ig concentration in human serum but also document the integrity of the molecule in vivo. Each anti-Id antibody may also be used as an "immunogen" to induce an immune response in yet another animal, producing a so-called anti-anti-Id antibody.

Further, it will be appreciated by one skilled in the art that a protein of interest may be expressed using a library of host cells genetically engineered to express various glycosylation enzymes, such that member host cells of the library produce the protein of interest with variant glycosylation patterns. A practitioner may then select and isolate the protein of interest with particular novel glycosylation patterns. Preferably, the protein having a particularly selected novel glycosylation pattern exhibits improved or altered biological properties.

7. Uses of IL-17 Binding Proteins

Given their ability to bind to human IL-17, the IL-17 binding proteins, or antigen binding portions thereof, of the invention can be used to detect IL-17A and/or human IL-17F (e.g., in a biological sample, such as serum or plasma), using a conventional immunoassay, such as an enzyme linked immunosorbent assays (ELISA), an radioimmunoassay (RIA) or tissue immunohistochemistry. The invention provides a method for detecting IL-17A and/or human IL-17F in a biological sample comprising contacting a biological sample with a binding protein, or antigen binding portion, of the invention and detecting either the binding protein (or antigen binding portion) bound to IL-17A and/or human IL-17F or unbound binding protein (or binding portion), to thereby detect IL-17A and/or human IL-17F in the biological sample. The binding protein is directly or indirectly labeled with a detectable substance to facilitate detection of the bound or unbound antibody. Suitable detectable substances include various enzymes, prosthetic groups, fluorescent materials, luminescent materials and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriaziny-lamine fluorescein, dansyl chloride or phycoerythrin; an example of a luminescent material includes luminol; and examples of suitable radioactive material include $^{3}H$, $^{14}C$, $^{35}S$, $^{90}Y$, $^{99}Tc$, $^{111}In$, $^{125}I$, $^{131}I$, $^{177}Lu$, $^{166}Ho$, or $^{153}Sm$.

Alternative to labeling the binding protein, human IL-17 can be assayed in biological fluids by a competition immunoassay utilizing rhIL-17 standards labeled with a detectable substance and an unlabeled human IL-17 binding protein. In this assay, the biological sample, the labeled rhIL-17 standards, and the human IL-17 binding protein are combined and the amount of labeled rhIL-17 standard bound to the unlabeled antibody is determined. The amount of human IL-17 in the biological sample is inversely proportional to the amount of labeled rhIL-17 standard bound to the IL-17 binding protein. Similarly, human IL-17 can also be assayed in biological fluids by a competition immunoassay utilizing rhIL-17 standards labeled with a detectable substance and an unlabeled human IL-17 binding protein.

The binding proteins and IL-17 binding portions of the invention preferably are capable of neutralizing human IL-17A and/or human IL-17F activity both in vitro and in vivo. Accordingly, such binding proteins and IL-17 binding portions thereof of the invention can be used to inhibit hIL-17A and/or hIL-17F activity, e.g., in a cell culture containing hIL-17A and/or hIL-17F, in human subjects, or in other mammalian subjects having IL-17A and/or IL-17F with which an antibody of the invention cross-reacts. In one embodiment, the invention provides a method for inhibiting hIL-17A and/or hIL-17F activity comprising contacting hIL-17A and/or hIL-17F with an IL-17 binding protein or binding portion thereof of the invention such that hIL-17A and/or hIL-17F activity is inhibited. For example, in a cell culture containing, or suspected of containing hIL-17A and/or hIL-17F, an IL-17 binding protein or binding portion thereof of the invention can be added to the culture medium to inhibit hIL-17A and/or h IL-17F activity in the culture.

In another embodiment, the invention provides a method for reducing hIL-17A and/or hIL-17F activity in a subject, advantageously from a subject suffering from a disease or disorder in which IL-17A or IL-17F activity is detrimental. The invention provides methods for reducing IL-17A and/or IL-17F activity in a subject suffering from such a disease or disorder, which method comprises administering to the subject an antibody or antibody portion of the invention such that IL-17A and/or IL-17F activity in the subject is reduced. Preferably, the IL-17A is human IL-17A, the IL-17F is human IL-17F, and the subject is a human subject. Alternatively, the subject can be a mammal expressing an IL-17A and/or IL-17F to which an antibody of the invention is capable of binding. Still further, the subject can be a mammal into which IL-17A and/or IL-17F has been introduced (e.g., by administration of IL-17A and/or IL-17F or by expression of an IL-17A and/or IL-17F transgene). An IL-17 binding protein of the invention can be administered to a human subject for therapeutic purposes. Moreover, a binding protein of the invention can be administered to a non-human mammal expressing an IL-17A and/or IL-17F with which the antibody is capable of binding for veterinary purposes or as an animal model of human disease. Regarding the latter, such animal models may be useful for evaluating the therapeutic efficacy of antibodies of the invention (e.g., testing of dosages and time courses of administration).

As used herein, the term "a disorder in which IL-17A and/or IL-17F activity is detrimental" is intended to include diseases and other disorders in which the presence of IL-17A and/or IL-17F in a subject suffering from the disorder has been shown to be or is suspected of being either responsible for the pathophysiology of the disorder or a factor that contributes to a worsening of the disorder. Accordingly, a disorder in which IL-17A and/or IL-17F activity is detrimental is a disorder in which reduction of IL-17A and/or IL-17F activity is expected to alleviate the symptoms and/or progression of the disorder. Such disorders may be evidenced, for example, by an increase in the concentration of IL-17A and/or IL-17F in a biological fluid of a subject suffering from the disorder (e.g., an increase in the concentration of IL-17A and/or IL-17F in serum, plasma, synovial fluid, etc. of the subject), which can be detected, for example, using an anti-IL-17 antibody as described above. Non-limiting examples of disorders that can be treated with the antibodies of the invention include those disorders discussed in the section below pertaining to pharmaceutical compositions of the antibodies of the invention.

The DVD-Igs of the invention may bind IL-17 (e.g., hIL-17 or hIL-17F) alone or multiple antigens (e.g., hIL-17 and another non-IL-17 antigen). Thus, a DVD-Ig may block or reduce activity of huIL-17 and the activity of another target antigen. Such other target antigens may include soluble targets (e.g., TNF) and cell surface receptor targets (e.g., VEGFR, EGFR).

Such other antigens include, but are not limited to, the targets listed in publically available databases, which databases include those that are available on the worldwide web and incorporated herein by reference. These target databases include those listing:

Therapeutic targets (xin.cz3.nus.edu.sg/group/cjttd/ttd.asp);
Cytokines and cytokine receptors (cytokinewebfacts.com/, copewithcytokines.de/cope.cgi, and cmbi.bjmu.edu.cn/cm-bidata/cgf/CGF_Database/cytokine.medic.kumamoto-u.ac.jp/CFC/indexR.html);
Chemokines (cytokine.medic.kumamoto-u.ac.jp/CFC/CK/Chemokine.html);
Chemokine receptors and GPCRs (csp.medic.kumamoto-u.ac.jp/CSP/Receptor.html, gper.org/7tm/);
Olfactory Receptors (senselab.med.yale.edu/senselab/ORDB/default.asp);
Receptors (iuphar-db.org/iuphar-rd/list/index.htm);
Cancer targets (cged.hgc.jp/cgi-bin/input.cgi);
Secreted proteins as potential antibody targets (spd.cbi.pk-u.edu.cn/);
Protein kinases (spd.cbi.pku.edu.cn/), and
Human CD markers (content.labvelocity.com) and (Zola H, 2005 CD molecules 2005: human cell differentiation molecules Blood, 106:3123-6).

DVD-Igs are useful as therapeutic agents to simultaneously block two or more different targets, i.e., hIL-17 (and/or hIL-17F) and one or more other non-IL-17 target antigens to enhance efficacy/safety and/or increase patient coverage. Such targets may include soluble targets (TNF) and cell surface receptor targets (VEGFR and EGFR).

Additionally, DVD-Igs of the invention can be employed for tissue-specific delivery (target a tissue marker and a disease mediator for enhanced local PK thus higher efficacy and/or lower toxicity), including intracellular delivery (targeting an internalizing receptor and a intracellular molecule), delivering to inside brain (targeting transferrin receptor and a CNS disease mediator for crossing the blood-brain barrier). DVD-Ig can also serve as a carrier protein to deliver an antigen to a specific location via binding to a non-neutralizing epitope of that antigen and also to increase the half-life of the antigen. Furthermore, DVD-Ig can be designed to either be physically linked to medical devices implanted into patients or target these medical devices (see Burke, Sandra E.; Kuntz, Richard E.; Schwartz, Lewis B., Zotarolimus eluting stents. Advanced Drug Delivery Reviews (2006), 58(3), 437-446; Surface coatings for biological activation and functionalization of medical devices, Hildebrand, H. F.; Blanchemain, N.; Mayer, G.; Chai, F.; Lefebvre, M.; Boschin, F., Surface and Coatings Technology (2006), 200(22-23), 6318-6324; Wu et al., "Drug/device combinations for local drug therapies and infection prophylaxis," *Biomaterials,* 27: 2450-2467 (2006); Marques et al., "Mediation of the Cytokine Network in the Implantation of Orthopedic Devices," Chapter 21, In *Biodegradable Systems in Tissue Engineering and Regenerative Medicine,* (Reis et al., eds.) (CRC Press LLC, Boca Raton, 2005) pp. 377-397. Briefly, directing appropriate types of cell to the site of medical implant may promote healing and restoring normal tissue function. Alternatively, inhibition of mediators (including but not limited to cytokines), released upon device implantation by a DVD-Ig coupled to or target to a device is also provided. For example, Stents have been used for years in interventional cardiology to clear blocked arteries and to improve the flow of blood to the heart muscle. However, traditional bare metal stents have been known to cause restenosis (re-narrowing of the artery in a treated area) in some patients and can lead to blood clots. Recently, an anti-CD34 antibody coated stent has been described which reduced restenosis and prevents blood clots from occurring by capturing endothelial progenitor cells (EPC) circulating throughout the blood. Endothelial cells are cells that line blood vessels, allowing blood to flow smoothly. The EPCs adhere to the hard surface of the stent forming a smooth layer that not only promotes healing but prevents restenosis and blood clots, complications previously associated with the use of stents (Aoji et al. 2005 J Am Coll Cardiol. 45(10):1574-9). In addition to improving outcomes for patients requiring stents, there are also implications for patients requiring cardiovascular bypass surgery. For example, a prosthetic vascular conduit (artificial artery) coated with anti-EPC antibodies would eliminate the need to use arteries from patients legs or arms for bypass surgery grafts. This would reduce surgery and anesthesia times, which in turn will reduce coronary surgery deaths. DVD-Ig are designed in such a way that it binds to a cell surface marker (such as CD34) as well as a protein (or an epitope of any kind, including but not limited to proteins, lipids and polysaccharides) that has been coated on the implanted device to facilitate the cell recruitment. Such approaches can also be applied to other medical implants in general. Alternatively, DVD-Igs can be coated on medical devices and upon implantation and releasing all DVDs from the device (or any other need which may require additional fresh DVD-Ig, including aging and denaturation of the already loaded DVD-Ig) the device could be reloaded by systemic administration of fresh DVD-Ig to the patient, where the DVD-Ig is designed to binds to a target of interest (a cytokine, a cell surface marker (such as CD34) etc.) with one set of binding sites and to a target coated on the device (including a protein, an epitope of any kind, including but not limited to lipids, polysaccharides and polymers) with the other. This technology has the advantage of extending the usefulness of coated implants.

A. Use of DVD-Igs in Various Diseases

DVD-Ig molecules of the invention are also useful as therapeutic molecules to treat various diseases. Such DVD molecules may bind one or more targets involved in a specific disease. Examples of such targets in various diseases are described below.

Human Autoimmune and Inflammatory Response

In one aspect, a DVD-Ig binding protein of the invention is capable of binding human IL-17A and one or more antigens that have been implicated in general autoimmune and inflammatory responses, including C5, CCL1 (1-309), CCL11 (eotaxin), CCL13 (mcp-4), CCL15 (MIP-1d), CCL16 (HCC-4), CCL17 (TARC), CCL18 (PARC), CCL19, CCL2 (mcp-1), CCL20 (MIP-3a), CCL21 (MIP-2), CCL23 (MPIF-1), CCL24 (MPIF-2/eotaxin-2), CCL25 (TECK), CCL26, CCL3 (MIP-1a), CCL4 (MIP-1b), CCL5 (RANTES), CCL7 (mcp-3), CCL8 (mcp-2), CXCL1, CXCL10 (IP-10), CXCL11 (1-TAC/IP-9), CXCL12 (SDF1), CXCL13, CXCL14, CXCL2, CXCL3, CXCL5 (ENA-78/LIX), CXCL6 (GCP-2), CXCL9, IL13, IL8, CCL13 (mcp-4), CCR1, CCR2, CCR3, CCR4, CCR5, CCR6, CCR7, CCR8, CCR9, CX3CR1, IL8RA, XCR1 (CCXCR1), IFNA2, IL10, IL13, IL17C, IL1A, IL1B, IL1F10, IL1F5, IL1F6, IL1F7, IL1F8, IL1F9, IL22, IL5, IL8, IL9, LTA, LTB, MIF, SCYE1 (endothelial Monocyte-activating cytokine), SPP1, TNF, TNFSF5, IFNA2, IL10RA, IL10RB, IL13, IL13RA1, IL5RA, IL9, IL9R, ABCF1, BCL6, C3, C4A, CEBPB, CRP, ICEBERG, IL1R1, IL1RN, IL8RB, LTB4R, TOLLIP, FADD, IRAK1, IRAK2, MYD88, NCK2, TNFAIP3, TRADD, TRAF1, TRAF2, TRAF3, TRAF4, TRAF5, TRAF6, ACVR1, ACVR1B, ACVR2, ACVR2B, ACVRL1, CD28, CD3E, CD3G, CD3Z, CD69, CD80, CD86, CNR1, CTLA4, CYSLTR1, FCER1A, FCER2, FCGR3A, GPR44, HAVCR2, OPRD1, P2RX7, TLR2, TLR3, TLR4, TLR5, TLR6, TLR7, TLR8, TLR9, TLR10, BLR1, CCL1, CCL2, CCL3, CCL4, CCL5, CCL7, CCL8, CCL11, CCL13, CCL15, CCL16, CCL17, CCL18, CCL19, CCL20, CCL21, CCL22, CCL23, CCL24, CCL25, CCR1, CCR2, CCR3, CCR4, CCR5, CCR6, CCR7, CCR8, CCR9, CX3CL1, CX3CR1, CXCL1, CXCL2, CXCL3, CXCL5, CXCL6, CXCL10, CXCL11, CXCL12, CXCL13, CXCR4, GPR2, SCYE1, SDF2, XCL1, XCL2, XCR1, AMH, AMHR2, BMPR1A, BMPR1B, BMPR2, C19orf10 (IL27w), CER1, CSF1, CSF2, CSF3, DKFZp451J0118, FGF2, GFI1, IFNA1, IFNB1, IFNG, IGF1, IL1A, IL1B, IL1R1, IL1R2, IL2, IL2RA, IL2RB, IL2RG, IL3, IL4, IL4R, IL5, IL5RA, IL6, IL6R, IL6ST, IL7, IL8, IL8RA, IL8RB, IL9, IL9R, IL10, IL10RA, IL10RB, IL11, IL11RA, IL12A, IL12B, IL12RB1, IL12RB2, IL13, IL13RA1, IL13RA2, IL15, IL15RA, IL16, IL17, IL17R, IL18, IL18R1, IL19, IL20, KITLG, LEP, LTA, LTB, LTB4R, LTB4R2, LTBR, MIF, NPPB, PDGFB, TBX21, TDGF1, TGFA, TGFB1, TGFB1I1, TGFB2, TGFB3, TGFBI, TGFBR1, TGFBR2, TGFBR3, TH1L, TNF, TNFRSF1A, TNFRSF1B, TNFRSF7, TNFRSF8, TNFRSF9, TNFRSF11A, TNFRSF21, TNFSF4, TNFSF5, TNFSF6, TNFSF11, VEGF, ZFPM2, and RNF110 (ZNF144).

Asthma

Allergic asthma is characterized by the presence of eosinophilia, goblet cell metaplasia, epithelial cell alterations, airway hyperreactivity (AHR), and Th2 and Th1 cytokine expression, as well as elevated serum IgE levels. It is now widely accepted that airway inflammation is the key factor underlying the pathogenesis of asthma, involving a complex interplay of inflammatory cells such as T cells, B cells, eosinophils, mast cells and macrophages, and of their secreted mediators including cytokines and chemokines. Corticosteroids are the most important anti-inflammatory treatment for asthma today, however their mechanism of action is non-specific and safety concerns exist, especially in the juvenile patient population. The development of more specific and targeted therapies is therefore warranted.

Animal models such as OVA-induced asthma mouse model, where both inflammation and AHR can be assessed, are known in the art and may be used to determine the ability of various DVD-Ig molecules to treat asthma Animal models for studying asthma are disclosed in Coffman, et al., Journal of Experimental Medicine (2005), 201(12), 1875-1879; Lloyd, et al., Advances in Immunology (2001), 77, 263-295; Boyce et al., Journal of Experimental Medicine (2005), 201 (12), 1869-1873; and Snibson, et al., Journal of the British Society for Allergy and Clinical Immunology (2005), 35(2), 146-52. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257).

One aspect of the invention pertains to DVD-Ig molecules capable of binding IL-17 (and/or IL-17F) and one or more, for example two, targets selected from the group consisting of IL-4, IL-5, IL-8, IL-9, IL-13, IL-18, IL-5R($\alpha$), TNFSF4, IL-4R($\alpha$), interferon $\alpha$, eotaxin, TSLP, PAR-2, PGD2, and IgE. An embodiment includes a dual-specific anti-IL-17/IL-13 DVD-Ig as a therapeutic agent beneficial for the treatment of asthma.

Rheumatoid Arthritis (RA)

Rheumatoid arthritis (RA), a systemic disease, is characterized by a chronic inflammatory reaction in the synovium of joints and is associated with degeneration of cartilage and erosion of juxta-articular bone. Many pro-inflammatory cytokines including TNF, chemokines, and growth factors are expressed in diseased joints. Systemic administration of anti-TNF antibody or sTNFR fusion protein to mouse models of RA was shown to be anti-inflammatory and joint protective. Various cytokines, included IL-17 have been implicated in RA. Clinical investigations in which the activity of TNF in RA patients was blocked with intravenously administered infliximab (Harriman G, Harper L K, Schaible T F. 1999 Summary of clinical trials in rheumatoid arthritis using infliximab, an anti-TNFalpha treatment. Ann. Rheum. Dis., 58 Suppl 1: I61-4), a chimeric anti-TNF mAb, has provided evidence that TNF regulates IL-6, IL-8, MCP-1, and VEGF production, recruitment of immune and inflammatory cells into joints, angiogenesis, and reduction of blood levels of matrix metalloproteinases-1 and -3. A better understanding of the inflammatory pathway in rheumatoid arthritis has led to identification of other therapeutic targets involved in rheumatoid arthritis. Promising treatments such as interleukin-6 antagonists (IL-6 receptor antibody MRA, developed by Chugai, Roche (see Nishimoto, Norihiro et al., *Arthritis & Rheumatism*, (2004), 50(6): 1761-1769), CTLA4Ig (abatacept, Genovese et al. (2005) "Abatacept for rheumatoid arthritis refractory to tumor necrosis factor alpha inhibition," *N. Engl. J. Med.*, 353: 1114-23.), and anti-B cell therapy (rituximab, Okamoto H, Kamatani N. (2004) "Rituximab for rheumatoid arthritis," *N. Engl. J. Med.*, 351: 1909) have already been tested in randomized controlled trials over the past year. IL-17 and other cytokines, such as IL-15 and IL-18, have been identified as playing a role using RA animal models (therapeutic antibody HuMax-IL_15, AMG 714 see Baslund, Bo et al., Arthritis & Rheumatism (2005), 52(9): 2686-2692). Dual-specific antibody therapy, combining anti-TNF and another mediator, such IL-17, has great potential in enhancing clinical efficacy and/or patient coverage. For example, blocking both TNF and VEGF can potentially eradicate inflammation and angiogenesis, both of which are involved in pathophysiology of RA. A DVD-Ig binding protein capable of blocking TNF-$\alpha$ and IL-17 is contemplated. In addition to routine safety assessments of these target pairs, specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Hart et al., Journal of Allergy and Clinical Immunology (2001), 108(2), 250-257). Whether a DVD-Ig molecule will be useful for the treatment of rheumatoid arthritis can be assessed using pre-clinical animal RA models such as the collagen-induced arthritis mouse model. Other useful models are also well known in the art (see Brand DD., *Comp. Med.*, (2005) 55(2):114-22). Based on the cross-reactivity of the parental antibodies for human and mouse orthologues (e.g., reactivity for human and mouse TNF, human and mouse IL-15 etc.) validation studies in the mouse CIA model may be conducted with "matched surrogate antibody" derived DVD- Ig molecules; briefly, a DVD-Ig based on two (or more) mouse target specific antibodies may be matched to the extent possible to the characteristics of the parental human or humanized antibodies used for human DVD-Ig construction (similar affinity, similar neutralization potency, similar half-life etc.).

In an embodiment, a DVD-Ig of the invention that binds hIL-17 and another non-IL-17 target may also be used to treat other diseases in which IL-17 plays. Such diseases include, but are not limited to SLE, multiple sclerosis (MS), sepsis, various neurological diseases, and cancers (including cervical, breast, gastric). A more extensive list of diseases and disorders in which IL-17 plays a role is also provided below.

An embodiment of the invention pertains to a DVD-Ig molecules capable of binding huIL-17 and/or hIL-17 F and one or more targets selected from the group consisting of TNFα, IL-12, TWEAK, IL-23, CXCL13, CD40, CD40L, IL-18, VEGF, VLA-4, TNFβ, CD45RB, CD200, IFN-γ, GM-CSF, FGF, C5, CD52, sclerostin, and CCR2.

SLE (Lupus)

The immunopathogenic hallmark of SLE is the polyclonal B cell activation, which leads to hyperglobulinemia, autoantibody production and immune complex formation. The fundamental abnormality appears to be the failure of T cells to suppress the forbidden B cell clones due to generalized T cell dysregulation. In addition, B and T-cell interaction is facilitated by several cytokines such as IL-10 as well as co-stimulatory molecules such as CD40 and CD40L, B7 and CD28 and CTLA-4, which initiate the second signal. These interactions together with impaired phagocytic clearance of immune complexes and apoptotic material, perpetuate the immune response with resultant tissue injury.

In one aspect, a DVD-Ig binding protein of the invention is capable of binding human IL-17A and one or more of the following antigens that have been implicated in SLE: B cell targeted therapies: CD-20, CD-22, CD-19, CD28, CD4, CD80, HLA-DRA, IL10, IL2, IL4, TNFRSF5, TNFRSF6, TNFSF5, TNFSF6, BLR1, HDAC4, HDAC5, HDAC7A, HDAC9, ICOSL, IGBP1, MS4A1, RGS1, SLA2, CD81, IFNB1, IL10, TNFRSF5, TNFRSF7, TNFSF5, AICDA, BLNK, GALNAC4S-6ST, HDAC4, HDAC5, HDAC7A, HDAC9, IL10, IL11, IL4, INHA, INHBA, KLF6, TNFRSF7, CD28, CD38, CD69, CD80, CD83, CD86, DPP4, FCER2, IL2RA, TNFRSF8, TNFSF7, CD24, CD37, CD40, CD72, CD74, CD79A, CD79B, CR2, IL1R2, ITGA2, ITGA3, MS4A1, ST6GAL1, CD1C, CHST10, HLA-A, HLA-DRA, and NT5E.; co-stimulatory signals: CTLA4 or B7.1/B7.2; inhibition of B cell survival: BlyS, BAFF; Complement inactivation: C5; Cytokine modulation: the key principle is that the net biologic response in any tissue is the result of a balance between local levels of proinflammatory or anti-inflammatory cytokines (see Sfikakis P P et al 2005 Curr Opin Rheumatol 17:550-7). SLE is considered to be a Th-2 driven disease with documented elevations in serum IL-4, IL-6, IL-10. DVD-Igs capable of binding one or more targets selected from the group consisting of IL-4, IL-6, IL-10, IFN-α, and TNF-α are also contemplated. Combination of targets discussed herein will enhance therapeutic efficacy for SLE which can be tested in a number of lupus preclinical models (see, Peng S L (2004) *Methods Mol. Med.*, 102: 227-72). Based on the cross-reactivity of the parental antibodies for human and mouse othologues (e.g., reactivity for human and mouse CD20, human and mouse Interferon alpha etc.) validation studies in a mouse lupus model may be conducted with "matched surrogate antibody" derived DVD-Ig molecules; briefly, a DVD-Ig based two (or more) mouse target specific antibodies may be matched to the extent possible to the characteristics of the parental human or humanized antibodies used for human DVD-Ig construction (similar affinity, similar neutralization potency, similar half-life etc.).

Multiple Sclerosis (MS)

Multiple sclerosis (MS) is a complex human autoimmune-type disease with a predominantly unknown etiology. Immunologic destruction of myelin basic protein (MBP) throughout the nervous system is the major pathology of multiple sclerosis. MS is a disease of complex pathologies, which involves infiltration by CD4+ and CD8+ T cells and of response within the central nervous system. Expression in the CNS of cytokines, reactive nitrogen species and costimulator molecules have all been described in MS. Of major consideration are immunological mechanisms that contribute to the development of autoimmunity. In particular, antigen expression, cytokine and leukocyte interactions, and regulatory T-cells, which help balance/modulate other T-cells such as Th1 and Th2 cells, are important areas for therapeutic target identification.

IL-12 is a proinflammatory cytokine that is produced by APC and promotes differentiation of Th1 effector cells. IL-12 is produced in the developing lesions of patients with MS as well as in EAE-affected animals. Previously it was shown that interference in IL-12 pathways effectively prevents EAE in rodents, and that in vivo neutralization of IL-12p40 using a anti-IL-12 mAb has beneficial effects in the myelin-induced EAE model in common marmosets.

TWEAK is a member of the TNF family, constitutively expressed in the central nervous system (CNS), with proinflammatory, proliferative or apoptotic effects depending upon cell types. Its receptor, Fn14, is expressed in CNS by endothelial cells, reactive astrocytes and neurons. TWEAK and Fn14 mRNA expression increased in spinal cord during experimental autoimmune encephalomyelitis (EAE). Anti-TWEAK antibody treatment in myelin oligodendrocyte glycoprotein (MOG) induced EAE in C57BL/6 mice resulted in a reduction of disease severity and leukocyte infiltration when mice were treated after the priming phase.

One aspect of the invention pertains to DVD-Ig molecules capable of binding IL-17 (and/or IL-17F) and one or more, for example two, targets selected from the group consisting of IL-12, TWEAK, IL-23, CXCL13, CD40, CD40L, IL-18, VEGF, VLA-4, TNF, CD45RB, CD200, IFNgamma, GM-CSF, FGF, C5, CD52, osteopontin, and CCR2. An embodiment includes a dual-specific anti-IL-17/TWEAK DVD-Ig as a therapeutic agent beneficial for the treatment of MS.

Several animal models for assessing the usefulness of the DVD-Ig molecules to treat MS are known in the art (see Steinman L, et al., (2005) Trends Immunol. 26(11):565-71; Lublin F D., et al., (1985) Springer Semin Immunopathol. 8(3):197-208; Genain C P, et al., (1997) J Mol. Med. 75(3): 187-97; Tuohy V K, et al., (1999) J Exp Med. 189(7):1033-42; Owens T, et al., (1995) Neurol Clin. 13(1):51-73; and 't Hart et al., *J. Immunol.*, 175(7): 4761-4768 (2005). Based on the cross-reactivity of the parental antibodies for human and animal species othologues (e.g., reactivity for human and mouse IL-17, human and mouse TWEAK etc.) validation studies in the mouse EAE model may be conducted with "matched surrogate antibody" derived DVD-Ig molecules; briefly, a DVD-Ig based on to (or more) mouse target specific antibodies may be matched to the extent possible to the characteristics of the parental human or humanized antibodies used for human DVD-Ig construction (similar affinity, similar neutralization potency, similar half-life etc.). The same concept applies to animal models in other non-rodent species, where a "matched surrogate antibody" derived DVD-Ig would be selected for the anticipated pharmacology and possibly safety studies. In addition to routine safety assessments of these target pairs specific tests for the degree of immunosuppression may be warranted and helpful in selecting the best target pairs (see Luster et al., Toxicology (1994), 92(1-3), 229-43; Descotes, et al., Developments in biological standardization (1992), 77 99-102; Jones R. 2000 Rovelizumab (ICOS Corp). IDrugs. 3(4):442-6).

Sepsis

The pathophysiology of sepsis is initiated by the outer membrane components of both gram-negative organisms (lipopolysaccharide [LPS], lipid A, endotoxin) and gram-positive organisms (lipoteichoic acid, peptidoglycan). These outer membrane components are able to bind to the CD14 receptor on the surface of monocytes. By virtue of the recently described toll-like receptors, a signal is then transmitted to the cell, leading to the eventual production of the proinflammatory cytokines tumor necrosis factor-alpha (TNF-alpha) and interleukin-1 (IL-1). Overwhelming inflammatory and immune responses are essential features of septic shock and play a central part in the pathogenesis of tissue damage, multiple organ failure, and death induced by sepsis. Cytokines, especially tumor necrosis factor (TNF) and interleukin (IL-1), have been shown to be critical mediators of septic shock. These cytokines have a direct toxic effect on tissues; they also activate phospholipase A2. These and other effects lead to increased concentrations of platelet-activating factor, promotion of nitric oxide synthase activity, promotion of tissue infiltration by neutrophils, and promotion of neutrophil activity.

The treatment of sepsis and septic shock remains a clinical conundrum, and recent prospective trials with biological response modifiers (i.e. anti-TNF, anti-MIF) aimed at the inflammatory response have shown only modest clinical benefit. Recently, interest has shifted toward therapies aimed at reversing the accompanying periods of immune suppression. Studies in experimental animals and critically ill patients have demonstrated that increased apoptosis of lymphoid organs and some parenchymal tissues contribute to this immune suppression, anergy, and organ system dysfunction. During sepsis syndromes, lymphocyte apoptosis can be triggered by the absence of IL-2 or by the release of glucocorticoids, granzymes, or the so-called 'death' cytokines: tumor necrosis factor alpha or Fas ligand. Apoptosis proceeds via auto-activation of cytosolic and/or mitochondrial caspases, which can be influenced by the pro- and anti-apoptotic members of the Bcl-2 family. In experimental animals, not only can treatment with inhibitors of apoptosis prevent lymphoid cell apoptosis; it may also improve outcome. Although clinical trials with anti-apoptotic agents remain distant due in large part to technical difficulties associated with their administration and tissue targeting, inhibition of lymphocyte apoptosis represents an attractive therapeutic target for the septic patient. Likewise, a dual-specific agent targeting both inflammatory mediator and a apoptotic mediator, may have added benefit. One aspect of the invention pertains to DVD-Igs capable of binding IL-17 and/or IL-17F and one or more targets involved in sepsis selected from the group consisting TNF, IL-1, MIF, IL-6, IL-8, IL-18, IL-12, IL-23, FasL, LPS, Toll-like receptors, TLR-4, tissue factor, MIP-2, ADORA2A, CASP1, CASP4, IL-10, IL-1B, NFKB1, PROC, TNFRSF1A, CSF3, CCR3, IL1RN, MIF, NFKB1, PTAFR, TLR2, TLR4, GPR44, HMOX1, HMG-B1, midkine, IRAK1, NFKB2, SERPINA1, SERPINE1, and TREM1. The efficacy of such DVD-Igs for sepsis can be assessed in preclinical animal models known in the art (see, Buras J A, et al., (2005) *Nat. Rev. Drug Discov.*, 4(10): 854-65 and Calandra T, et al., (2000) *Nat. Med.*, 6(2):164-70).

Neurological Disorders and Neurodegenerative Diseases

Neurodegenerative diseases are either chronic in which case they are usually age-dependent or acute (e.g., stroke, traumatic brain injury, spinal cord injury, etc.). They are characterized by progressive loss of neuronal functions (neuronal cell death, demyelination), loss of mobility and loss of memory. Emerging knowledge of the mechanisms underlying chronic neurodegenerative diseases (e.g., Alzheimer's disease, AD) show a complex etiology and a variety of factors have been recognized to contribute to their development and progression e.g., age, glycemic status, amyloid production and multimerization, accumulation of advanced glycation-end products (AGE) which bind to their receptor RAGE (receptor for AGE), increased brain oxidative stress, decreased cerebral blood flow, neuroinflammation including release of inflammatory cytokines and chemokines, neuronal dysfunction and microglial activation. Thus these chronic neurodegenerative diseases represent a complex interaction between multiple cell types and mediators. Treatment strategies for such diseases are limited and mostly constitute either blocking inflammatory processes with non-specific anti-inflammatory agents (e.g., corticosteroids, COX inhibitors) or agents to prevent neuron loss and/or synaptic functions. These treatments fail to stop disease progression. Recent studies suggest that more targeted therapies such as antibodies to soluble A$\beta$ peptide (including the A$\beta$ oligomeric forms) can not only help stop disease progression but may help maintain memory as well. These preliminary observations suggest that specific therapies targeting more than one disease mediator (e.g., A$\beta$ and a pro-inflammatory cytokine such as TNF) may provide even better therapeutic efficacy for chronic neurodegenerative diseases than observed with targeting a single disease mechanism (e.g., soluble A$\beta$ alone) (see C. E. Shepherd, et al, Neurobiol Aging. 2005 Oct. 24; Nelson R B., Curr Pharm Des. 2005; 11:3335; William L. Klein.; Neurochem Int. 2002; 41:345; Janelsins et al., "Early correlation of microglial activation with enhanced tumor necrosis factor-alpha and monocyte chemoattractant protein-I expression specifically within the entorhinal cortex of triple transgenic Alzheimer's disease mice," *Journal of Neuroinflammation*, 2(23): 1-12 (2005); Soloman B., Curr Alzheimer Res. 2004; 1:149; Igor Klyubin, et al., Nat. Med. 2005; 11:556-61; Arancio O, et al., EMBO Journal (2004) 1-10; Bornemann K D, et al., Am J Pathol. 2001; 158:63; Deane R, et al., Nat Med. 2003; 9:907-13; and Eliezer Masliah, et al., Neuron. 2005; 46:857).

The DVD-Ig molecules of the invention can bind IL-17 (and/or IL-17F) and one or more targets involved in chronic neurodegenerative diseases such as Alzheimers. Such targets include, but are not limited to, any mediator, soluble or cell surface, implicated in AD pathogenesis, e.g., AGE (S100 A, amphotericin), pro-inflammatory cytokines (e.g., IL-1), chemokines (e.g., MCP 1), molecules that inhibit nerve regeneration (e.g., Nogo, RGM A), molecules that enhance neurite growth (neurotrophins) and molecules that can mediate transport at the blood brain barrier (e.g., transferrin receptor, insulin receptor or RAGE). The efficacy of DVD-Ig molecules can be validated in pre-clinical animal models such as the transgenic mice that over-express amyloid precursor protein or RAGE and develop Alzheimer's disease-like symptoms. In addition, DVD-Ig molecules can be constructed and tested for efficacy in the animal models and the best therapeutic DVD-Ig can be selected for testing in human patients. DVD-Ig molecules can also be employed for treatment of other neurodegenerative diseases such as Parkinson's disease. Alpha-Synuclein is involved in Parkinson's pathology. A DVD-Ig capable of targeting IL-17 (and/or IL-17F) and LINGO-1, alpha-synuclein, and/or inflammatory mediators such as TNF, IL-1, MCP-1 can prove effective therapy for Parkinson's disease and are contemplated in the invention.

Neuronal Regeneration and Spinal Cord Injury

Despite an increase in knowledge of the pathologic mechanisms, spinal cord injury (SCI) is still a devastating condition and represents a medical indication characterized by a high medical need. Most spinal cord injuries are contusion or compression injuries and the primary injury is usually followed by secondary injury mechanisms (inflammatory mediators e.g., cytokines and chemokines) that worsen the initial injury and result in significant enlargement of the lesion area, sometimes more than 10-fold. These primary and secondary mechanisms in SCI are very similar to those in brain injury caused by other means e.g., stroke. No satisfying treatment exists and high dose bolus injection of methylprednisolone (MP) is the only used therapy within a narrow time window of 8 h post injury. This treatment, however, is only intended to prevent secondary injury without causing any significant functional recovery. It is heavily criticized for the lack of unequivocal efficacy and severe adverse effects, like immunosuppression with subsequent infections and severe histopathological muscle alterations. No other drugs, biologics or small molecules, stimulating the endogenous regenerative potential are approved, but promising treatment principles and drug candidates have shown efficacy in animal models of SCI in recent years. To a large extent the lack of functional recovery in human SCI is caused by factors inhibiting neurite growth, at lesion sites, in scar tissue, in myelin as well as on injury-associated cells. Such factors are the myelin-associated proteins NogoA, OMgp and MAG, RGM A, the scar-associated CSPG (Chondroitin Sulfate Proteoglycans) and inhibitory factors on reactive astrocytes (some semaphorins and ephrins). However, at the lesion site not only growth inhibitory molecules are found but also neurite growth stimulating factors like neurotrophins, laminin, L1 and others. This ensemble of neurite growth inhibitory and growth promoting molecules may explain that blocking single factors, like NogoA or RGM A, resulted in significant functional recovery in rodent SCI models, because a reduction of the inhibitory influences could shift the balance from growth inhibition to growth promotion. However, recoveries observed with blocking a single neurite outgrowth inhibitory molecule were not complete. To achieve faster and more pronounced recoveries either blocking two neurite outgrowth inhibitory molecules, e.g., Nogo and RGM A, or blocking an neurite outgrowth inhibitory molecule and enhancing functions of a neurite outgrowth enhancing molecule, e.g., Nogo and neurotrophins, or blocking a neurite outgrowth inhibitory molecule, e.g., Nogo and a pro-inflammatory molecule e.g., TNF, may be desirable (see McGee A W, et al. (2003) *Trends Neurosci.*, 26: 193; Marco Domeniconi, et al. (2005) *J. Neurol. Sci.*, 233: 43; Milan Makwana 1, et al. (2005) FEBS J. 272:2628; Barry J. Dickson (2002) *Science*, 298: 1959; Felicia Yu Hsuan Teng, et al. (2005) J. Neurosci. Res. 79:273; Tara Karnezis, et al. (2004) *Nature Neuroscience*, 7: 736; Gang Xu, et al. (2004) *J. Neurochem.*, 91: 1018).

In one aspect, a DVD-Ig that binds hIL-17 and/or hIL-17F may also bind one or both of the target pairs such as NgR and RGM A; NogoA and RGM A; MAG and RGM A; OMGp and RGM A; RGM A and RGM B; CSPGs and RGM A; aggrecan, midkine, neurocan, versican, phosphacan, Te38 and TNF-α; Aβ globulomer-specific antibodies combined with antibodies promoting dendrite & axon sprouting are provided. Dendrite pathology is a very early sign of AD and it is known that NOGO A restricts dendrite growth. One can combine such type of ab with any of the SCI-candidate (myelin-proteins) Ab. Other DVD-Ig targets may include any combination of NgR-p75, NgR-Troy, NgR-Nogo66 (Nogo), NgR-Lingo, Lingo-Troy, Lingo-p75, MAG or Omgp. Additionally, targets may also include any mediator, soluble or cell surface, implicated in inhibition of neurite, e.g., Nogo, Ompg, MAG, RGM A, semaphorins, ephrins, soluble Aβ, pro-inflammatory cytokines (e.g., IL-1), chemokines (e.g., MIP 1a), molecules that inhibit nerve regeneration. The efficacy of anti-nogo/anti-RGM A or similar DVD-Ig molecules can be validated in pre-clinical animal models of spinal cord injury. In addition, these DVD-Ig molecules can be constructed and tested for efficacy in the animal models and the best therapeutic DVD-Ig can be selected for testing in human patients. In addition, DVD-Ig molecules can be constructed that target two distinct ligand binding sites on a single receptor e.g., Nogo receptor which binds three ligand Nogo, Ompg, and MAG and RAGE that binds Aβ and S100 A. Furthermore, neurite outgrowth inhibitors e.g., nogo and nogo receptor, also play a role in preventing nerve regeneration in immunological diseases like multiple sclerosis. Inhibition of nogo-nogo receptor interaction has been shown to enhance recovery in animal models of multiple sclerosis. Therefore, DVD-Ig molecules that can block the function of one immune mediator, e.g., a cytokine like IL-12, and a neurite outgrowth inhibitor molecule, e.g., Nogo or RGM, may offer faster and greater efficacy than blocking either an immune or a neurite outgrowth inhibitor molecule alone.

In general, antibodies do not cross the blood brain barrier (BBB) in an efficient and relevant manner. However, in certain neurologic diseases, e.g., stroke, traumatic brain injury, multiple sclerosis, etc., the BBB may be compromised and allows for increased penetration of DVD-Igs and antibodies into the brain. In other neurological conditions, where BBB leakage is not occurring, one may employ the targeting of endogenous transport systems, including carrier-mediated transporters such as glucose and amino acid carriers and receptor-mediated transcytosis-mediating cell structures/receptors at the vascular endothelium of the BBB, thus enabling trans-BBB transport of the DVD-Ig. Structures at the BBB enabling such transport include but are not limited to the insulin receptor, transferrin receptor, LRP and RAGE. In addition, strategies enable the use of DVD-Igs also as shuttles to transport potential drugs into the CNS including low molecular weight drugs, nanoparticles and nucleic acids (Coloma M J, et al. (2000) Pharm Res. 17(3):266-74; Boado R J, et al. (2007) Bioconjug. Chem. 18(2):447-55).

Oncological Disorders

Monoclonal antibody therapy has emerged as an important therapeutic modality for cancer (von Mehren et al., *Annu. Rev. Med.*, 54: 343-69 (2003)). Antibodies may exert antitumor effects by inducing apoptosis, redirected cytotoxicity, interfering with ligand-receptor interactions, or preventing the expression of proteins that are critical to the neoplastic phenotype. In addition, antibodies can target components of the tumor microenvironment, perturbing vital structures such as the formation of tumor-associated vasculature. Antibodies can also target receptors whose ligands are growth factors, such as the epidermal growth factor receptor. The antibody thus inhibits natural ligands that stimulate cell growth from binding to targeted tumor cells. Alternatively, antibodies may induce an anti-idiotype network, complement-mediated cytotoxicity, or antibody-dependent cellular cytotoxicity (ADCC). The use of dual-specific antibody that targets two separate tumor mediators will likely give additional benefit compared to a mono-specific therapy.

In another embodiment, a DVD-Ig that binds hIL-17 (and/or hIL-17F) of the invention may also be capable of binding another target involved in oncological diseases including, but not limited to: IGFR, IGF, VGFR1, PDGFRb, PDGFRa, IGF1,2, ERB3, CDCP, 1BSG2, ErbB3, CD52, CD20, CD19, CD3, CD4, CD8, BMP6, IL12A, IL1A, IL1B, IL2, IL24, INHA, TNF, TNFSF10, BMP6, EGF, FGF1, FGF10, FGF11, FGF12, FGF13, FGF14, FGF16, FGF17, FGF18, FGF19, FGF2, FGF20, FGF21, FGF22, FGF23, FGF3, FGF4, FGF5, FGF6, FGF7, FGF8, FGF9, GRP, IGF1, IGF2, IL12A, IL1A, IL1B, IL2, INHA, TGFA, TGFB1, TGFB2, TGFB3, VEGF, CDK2, FGF10, FGF18, FGF2, FGF4, FGF7, IGF1R, IL2, BCL2, CD164, CDKN1A, CDKN1B, CDKN1C, CDKN2A, CDKN2B, CDKN2C, CDKN3, GNRH1, IGFBP6, IL1A, IL1B, ODZ1, PAWR, PLG, TGFB1I1, AR, BRCA1, CDK3, CDK4, CDK5, CDK6, CDK7, CDK9, E2F1, EGFR, ENO1, ERBB2, ESR1, ESR2, IGFBP3, IGFBP6, IL2, INSL4, MYC, NOX5, NR6A1, PAP, PCNA, PRKCQ, PRKD1, PRL, TP53, FGF22, FGF23, FGF9, IGFBP3, IL2, INHA, KLK6, TP53, CHGB, GNRH1, IGF1, IGF2, INHA, INSL3, INSL4, PRL, KLK6, SHBG, NR1D1, NR1H3, NR1I3, NR2F6, NR4A3, ESR1, ESR2, NR0B1, NR0B2, NR1D2, NR1H2, NR1H4, NR1I2, NR2C1, NR2C2, NR2E1, NR2E3, NR2F1, NR2F2, NR3C1, NR3C2, NR4A1, NR4A2, NR5A1, NR5A2, NR6A1, PGR, RARB, FGF1, FGF2, FGF6, KLK3, KRT1, APOC1, BRCA1, CHGA, CHGB, CLU, COL1A1, COL6A1, EGF, ERBB2, ERK8, FGF1, FGF10, FGF11, FGF13, FGF14, FGF16, FGF17, FGF18, FGF2, FGF20, FGF21, FGF22, FGF23, FGF3, FGF4, FGF5, FGF6, FGF7, FGF8, FGF9, GNRH1, IGF1, IGF2, IGFBP3, IGFBP6, IL12A, IL1A, IL1B, IL2, IL24, INHA, INSL3, INSL4, KLK10, KLK12, KLK13, KLK14, KLK15, KLK3, KLK4, KLK5, KLK6, KLK9, MMP2, MMP9, MSMB, NTN4, ODZ1, PAP, PLAU, PRL, PSAP, SERPINA3, SHBG, TGFA, TIMP3, CD44, CDH1, CDH10, CDH19, CDH20, CDH7, CDH9, CDH1, CDH10, CDH13, CDH18, CDH19, CDH20, CDH7, CDH8, CDH9, ROBO2, CD44, ILK, ITGA1, APC, CD164, COL6A1, MTSS1, PAP, TGFB1I1, AGR2, AIG1, AKAP1, AKAP2, CANT1, CAV1, CDH12, CLDN3, CLN3, CYB5, CYC1, DAB2IP, DES, DNCL1, ELAC2, ENO2, ENO3, FASN, FLJ12584, FLJ25530, GAGEB1, GAGEC1, GGT1, GSTP1, HIP1, HUMCYT2A, IL29, K6HF, KAI1, KRT2A, MIB1, PART1, PATE, PCA3, PIAS2, PIK3CG, PPID, PR1, PSCA, SLC2A2, SLC33A1, SLC43A1, STEAP, STEAP2, TPM1, TPM2, TRPC6, ANGPT1, ANGPT2, ANPEP, ECGF1, EREG, FGF1, FGF2, FIGF, FLT1, JAG1, KDR, LAMAS, NRP1, NRP2, PGF, PLXDC1, STAB1, VEGF, VEGFC, ANGPTL3, BAI1, COL4A3, IL8, LAMAS, NRP1, NRP2, STAB1, ANGPTL4, PECAM1, PF4, PROK2, SERPINF1, TNFAIP2, CCL11, CCL2, CXCL1, CXCL10, CXCL3, CXCL5, CXCL6, CXCL9, IFNA1, IFNB1, IFNG, IL1B, 1L6, MDK, EDG1, EFNA1, EFNA3, EFNB2, EGF, EPHB4, FGFR3, HGF, IGF1, ITGB3, PDGFA, TEK, TGFA, TGFB1, TGFB2, TGFBR1, CCL2, CDH5, COL18A1, EDG1, ENG, ITGAV, ITGB3, THBS1, THBS2, BAD, BAG1, BCL2, CCNA1, CCNA2, CCND1, CCNE1, CCNE2, CDH1 (E-cadherin), CDKN1B (p27Kip1), CDKN2A (p16INK4a), COL6A1, CTNNB1 (b-catenin), CTSB (cathepsin B), ERBB2 (Her-2), ESR1, ESR2, F3 (TF), FOSL1 (FRA-1), GATA3, GSN (Gelsolin), IGFBP2, IL2RA, IL6, IL6R, IL6ST (glycoprotein 130), ITGA6 (a6 integrin), JUN, KLK5, KRT19, MAP2K7 (c-Jun), MKI67 (Ki-67), NGFB (NGF), NGFR, NME1 (NM23A), PGR, PLAU (uPA), PTEN, SERPINB5 (maspin), SERPINE1 (PAI-1), TGFA, THBS1 (thrombospondin-1), TIE (Tie-1), TNFRSF6 (Fas), TNFSF6 (FasL), TOP2A (topoisomerase Iia), TP53, AZGP1 (zinc-aglycoprotein), BPAG1 (plectin), CDKN1A (p21Wap1/Cip1), CLDN7 (claudin-7), CLU (clusterin), ERBB2 (Her-2), FGF1, FLRT1 (fibronectin), GABRP (GABAa), GNAS1, ID2, ITGA6 (a6 integrin), ITGB4 (b 4 integrin), KLF5 (GC Box BP), KRT19 (Keratin 19), KRTHB6 (hair-specific type II keratin), MACMARCKS, MT3 (metallothionectin-III), MUC1 (mucin), PTGS2 (COX-2), RAC2 (p21Rac2), S100A2, SCGB1D2 (lipophilin B), SCGB2A1 (mammaglobin 2), SCGB2A2 (mammaglobin 1), SPRR1B (Spr1), THBS1, THBS2, THBS4, and TNFAIP2 (B94), RON, c-Met, CD64, DLL4, PLGF, CTLA4, phosphatidylserine, ROBO4, CD80, CD22, CD40, CD23, CD28, CD55, CD38, CD70, CD74, CD30, CD138, CD56, CD33, CD2, CD137, DR4, DRS, RANKL, VEGFR2, PDGFR, VEGFR1, MTSP1, MSP, EPHB2, EPHA1, EPHA2, EpCAM, PGE2, NKG2D, LPA, SIP, APRIL, BCMA, MAPG, FLT3, PDGFR alpha, PDGFR beta, ROR1, PSMA, PSCA, SCD1, and CD59.

D. Pharmaceutical Composition

The invention also provides pharmaceutical compositions comprising an antibody, or antigen-binding portion thereof, of the invention and a pharmaceutically acceptable carrier. The pharmaceutical compositions comprising antibodies of the invention are for use in, but not limited to, diagnosing, detecting, or monitoring a disorder, in preventing, treating, managing, or ameliorating of a disorder or one or more symptoms thereof, and/or in research. In a specific embodiment, a composition comprises one or more antibodies of the invention. In another embodiment, the pharmaceutical composition comprises one or more antibodies of the invention and one or more prophylactic or therapeutic agents other than antibodies of the invention for treating a disorder in which IL-17A and/or IL-17F activity is detrimental. In an embodiment, the prophylactic or therapeutic agents are known to be useful for or having been or currently being used in the prevention, treatment, management, or amelioration of a disorder or one or more symptoms thereof. In accordance with these embodiments, the composition may further comprise of a carrier, diluent or excipient.

The antibodies and antibody portions of the invention can be incorporated into pharmaceutical compositions suitable for administration to a subject. Typically, the pharmaceutical composition comprises an antibody or antibody portion of the invention and a pharmaceutically acceptable carrier. As used herein, "pharmaceutically acceptable carrier" includes any and all solvents, dispersion media, coatings, antibacterial and antifungal agents, isotonic and absorption delaying agents, and the like that are physiologically compatible. Examples of pharmaceutically acceptable carriers include one or more of water, saline, phosphate buffered saline, dextrose, glycerol, ethanol and the like, as well as combinations thereof. In many cases, it will be preferable to include isotonic agents, for example, sugars, polyalcohols such as mannitol, sorbitol, or sodium chloride in the composition. Pharmaceutically acceptable carriers may further comprise minor amounts of auxiliary substances such as wetting or emulsifying agents, preservatives or buffers, which enhance the shelf life or effectiveness of the antibody or antibody portion.

Various delivery systems are known and can be used to administer one or more antibodies of the invention or the combination of one or more antibodies of the invention and a prophylactic agent or therapeutic agent useful for preventing, managing, treating, or ameliorating a disorder or one or more symptoms thereof, e.g., encapsulation in liposomes, microparticles, microcapsules, recombinant cells capable of expressing the antibody or antibody fragment, receptor-mediated endocytosis (see, e.g., Wu and Wu, *J. Biol. Chem.*, 262: 4429-4432 (1987)), construction of a nucleic acid as part of a retroviral or other vector. Methods of administering a prophylactic or therapeutic agent of the invention include, but are not limited to, parenteral administration (e.g., intradermal, intramuscular, intraperitoneal, intravenous and subcutaneous), epidural administration, intratumoral administration, and mucosal administration (e.g., intranasal and oral routes). In addition, pulmonary administration can be employed, e.g., by use of an inhaler or nebulizer, and formulation with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244, WO 97/32572, WO 97/44013, WO 98/31346, and WO 99/66903, each of which is incorporated herein by reference their entireties. In one embodiment, an antibody or antibody portion of the invention, combination therapy, or a composition of the invention is administered using Alkermes AIR® pulmonary drug delivery technology (Alkermes, Inc., Cambridge, Mass., US). In a specific embodiment, prophylactic or therapeutic agents of the invention are administered intramuscularly, intravenously, intratumorally, orally, intranasally, pulmonary, or subcutaneously. The prophylactic or therapeutic agents may be administered by any convenient route, for example by infusion or bolus injection, by absorption through epithelial or mucocutaneous linings (e.g., oral mucosa, rectal, and intestinal mucosa, etc.) and may be administered together with other biologically active agents. Administration can be systemic or local.

In an embodiment, specific binding of antibody-coupled carbon nanotubes (CNTs) to tumor cells in vitro, followed by their highly specific ablation with near-infrared (NIR) light can be used to target tumor cells. For example, biotinylated polar lipids can be used to prepare stable, biocompatible, noncytotoxic CNT dispersions that are then attached to one or two different neutralite avidin-derivatized DVD-Igs directed against one or more tumor antigens (e.g., CD22) (Chakravarty, P. et al. (2008) *Proc. Natl. Acad. Sci. USA,* 105:8697-8702).

In a specific embodiment, it may be desirable to administer the prophylactic or therapeutic agents of the invention locally to the area in need of treatment; this may be achieved by, for example, and not by way of limitation, local infusion, by injection, or by means of an implant, said implant being of a porous or non-porous material, including membranes and matrices, such as sialastic membranes, polymers, fibrous matrices (e.g., Tissuel®), or collagen matrices. In one embodiment, an effective amount of one or more antibodies of the invention antagonists is administered locally to the affected area to a subject to prevent, treat, manage, and/or ameliorate a disorder or a symptom thereof. In another embodiment, an effective amount of one or more antibodies of the invention is administered locally to the affected area in combination with an effective amount of one or more therapies (e.g., one or more prophylactic or therapeutic agents) other than an antibody of the invention of a subject to prevent, treat, manage, and/or ameliorate a disorder or one or more symptoms thereof.

In another embodiment, the prophylactic or therapeutic agent can be delivered in a controlled release or sustained release system. In one embodiment, a pump may be used to achieve controlled or sustained release (see Langer, supra; Sefton, 1987, *CRC Crit. Ref. Biomed. Eng.,* 14: 20; Buchwald et al., 1980, *Surgery,* 88: 507; Saudek et al., 1989, *N. Engl. J. Med.,* 321: 574). In another embodiment, polymeric materials can be used to achieve controlled or sustained release of the therapies of the invention (see, e.g., Goodson, J. M., Chapter 6, In *Medical Applications of Controlled Release, Vol. II, Applications and Evaluation,* (Langer and Wise, eds.) (CRC Press, Inc., Boca Raton, 1984), pp. 115-138; Ranger and Peppas, 1983, J. Macromol. Sci. Rev. Macromol. Chem. 23:61; see also Levy et al., 1985, Science 228:190; During et al., 1989, Ann. Neurol. 25:351; Howard et al., 1989, J. Neurosurg. 7 1:105); U.S. Pat. No. 5,679,377; U.S. Pat. No. 5,916,597; U.S. Pat. No. 5,912,015; U.S. Pat. No. 5,989,463; U.S. Pat. No. 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In a preferred embodiment, the polymer used in a sustained release formulation is inert, free of leachable impurities, stable on storage, sterile, and biodegradable. In yet another embodiment, a controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990, Science 249:1527-1533). Any technique known to one of skill in the art can be used to produce sustained release formulations comprising one or more therapeutic agents of the invention. See, e.g., U.S. Pat. No. 4,526, 938, PCT publication WO 91/05548, PCT publication WO 96/20698, Ning et al., 1996, "Intratumoral Radioimmunotherapy of a Human Colon Cancer Xenograft Using a Sustained-Release Gel," *Radiotherapy & Oncology,* 39: 179-189, Song et al., 1995, "Antibody Mediated Lung Targeting of Long-Circulating Emulsions," PDA Journal of Pharmaceutical Science &Technology, 50: 372-397, Cleek et al., 1997, "Biodegradable Polymeric Carriers for a bFGF Antibody for Cardiovascular Application," Pro. Int'l. Symp. Control. Rel. Bioact. Mater. 24: 853-854, and Lam et al., 1997, "Microencapsulation of Recombinant Humanized Monoclonal Antibody for Local Delivery," Proc. Int'l. Symp. Control Rel. Bioact. Mater. 24: 759-760, each of which is incorporated herein by reference in their entireties.

In a specific embodiment, where the composition of the invention is a nucleic acid encoding a prophylactic or therapeutic agent, the nucleic acid can be administered in vivo to promote expression of its encoded prophylactic or therapeutic agent, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, Dupont), or coating with lipids or cell-surface receptors or transfecting agents, or by administering it in linkage to a homeobox-like peptide which is known to enter the nucleus (see, e.g., Joliot et al., 1991, *Proc. Natl. Acad. Sci. USA,* 88: 1864-1868). Alternatively, a nucleic acid can be introduced intracellularly and incorporated within host cell DNA for expression by homologous recombination.

A pharmaceutical composition of the invention is formulated to be compatible with its intended route of administration. Examples of routes of administration include, but are not limited to, parenteral, e.g., intravenous, intradermal, subcutaneous, oral, intranasal (e.g., inhalation), transdermal (e.g., topical), transmucosal, and rectal administration. In a specific embodiment, the composition is formulated in accordance with routine procedures as a pharmaceutical composition adapted for intravenous, subcutaneous, intramuscular, oral, intranasal, or topical administration to human beings. Typically, compositions for intravenous administration are solutions in sterile isotonic aqueous buffer. Where necessary, the composition may also include a solubilizing agent and a local anesthetic, such as lignocamne, to ease pain at the site of the injection.

If the compositions of the invention are to be administered topically, the compositions can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). For non-sprayable topical dosage forms, viscous to semi-solid or solid forms comprising a carrier or one or more excipients compatible with topical application and having a dynamic viscosity preferably greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations wherein the active ingredient, preferably in combination with a solid or liquid inert carrier, is packaged in a mixture with a pressurized volatile (e.g., a gaseous propellant, such as FREON®) or in a squeeze bottle. Moisturizers or humectants can also be added to pharmaceutical compositions and dosage forms if desired. Examples of such additional ingredients are well known in the art.

If the method of the invention comprises intranasal administration of a composition, the composition can be formulated in an aerosol form, spray, mist or in the form of drops. In particular, prophylactic or therapeutic agents for use according to the present invention can be conveniently delivered in the form of an aerosol spray presentation from pressurized packs or a nebulizer, with the use of a suitable propellant (e.g., dichlorodifluoromethane, trichlorofluoromethane, dichlorotetrafluoroethane, carbon dioxide or other suitable gas). In the case of a pressurized aerosol the dosage unit may be determined by providing a valve to deliver a metered amount. Capsules and cartridges (composed of, e.g., gelatin) for use in an inhaler or insufflator may be formulated containing a powder mix of the compound and a suitable powder base such as lactose or starch.

If the method of the invention comprises oral administration, compositions can be formulated orally in the form of tablets, capsules, cachets, gelcaps, solutions, suspensions, and the like. Tablets or capsules can be prepared by conventional means with pharmaceutically acceptable excipients such as binding agents (e.g., pregelatinised maize starch, polyvinylpyrrolidone, or hydroxypropyl methylcellulose); fillers (e.g., lactose, microcrystalline cellulose, or calcium hydrogen phosphate); lubricants (e.g., magnesium stearate, talc, or silica); disintegrants (e.g., potato starch or sodium starch glycolate); or wetting agents (e.g., sodium lauryl sulphate). The tablets may be coated by methods well-known in the art. Liquid preparations for oral administration may take the form of, but not limited to, solutions, syrups or suspensions, or they may be presented as a dry product for constitution with water or other suitable vehicle before use. Such liquid preparations may be prepared by conventional means with pharmaceutically acceptable additives such as suspending agents (e.g., sorbitol syrup, cellulose derivatives, or hydrogenated edible fats); emulsifying agents (e.g., lecithin or acacia); non-aqueous vehicles (e.g., almond oil, oily esters, ethyl alcohol, or fractionated vegetable oils); and preservatives (e.g., methyl or propyl-p-hydroxybenzoates or sorbic acid). The preparations may also contain buffer salts, flavoring, coloring, and sweetening agents as appropriate. Preparations for oral administration may be suitably formulated for slow release, controlled release, or sustained release of a prophylactic or therapeutic agent(s).

The method of the invention may comprise pulmonary administration, e.g., by use of an inhaler or nebulizer, of a composition formulated with an aerosolizing agent. See, e.g., U.S. Pat. Nos. 6,019,968; 5,985,320; 5,985,309; 5,934,272; 5,874,064; 5,855,913; 5,290,540; and 4,880,078; and PCT Publication Nos. WO 92/19244, WO 97/32572, WO 97/44013, WO 98/31346, and WO 99/66903, each of which is incorporated herein by reference their entireties. In a specific embodiment, an antibody of the invention, combination therapy, and/or composition of the invention is administered using Alkermes AIR® pulmonary drug delivery technology (Alkermes, Inc., Cambridge, Mass.).

The method of the invention may comprise administration of a composition formulated for parenteral administration by injection (e.g., by bolus injection or continuous infusion). Formulations for injection may be presented in unit dosage form (e.g., in ampoules or in multi-dose containers) with an added preservative. The compositions may take such forms as suspensions, solutions or emulsions in oily or aqueous vehicles, and may contain formulatory agents such as suspending, stabilizing and/or dispersing agents. Alternatively, the active ingredient may be in powder form for constitution with a suitable vehicle (e.g., sterile pyrogen-free water) before use.

The methods of the invention may additionally comprise of administration of compositions formulated as depot preparations. Such long acting formulations may be administered by implantation (e.g., subcutaneously or intramuscularly) or by intramuscular injection. Thus, for example, the compositions may be formulated with suitable polymeric or hydrophobic materials (e.g., as an emulsion in an acceptable oil) or ion exchange resins, or as sparingly soluble derivatives (e.g., as a sparingly soluble salt).

The methods of the invention encompass administration of compositions formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

Generally, the ingredients of compositions are supplied either separately or mixed together in unit dosage form, for example, as a dry lyophilized powder or water free concentrate in a hermetically sealed container such as an ampoule or sachet indicating the quantity of active agent. Where the mode of administration is infusion, composition can be dispensed with an infusion bottle containing sterile pharmaceutical grade water or saline. Where the mode of administration is by injection, an ampoule of sterile water for injection or saline can be provided so that the ingredients may be mixed prior to administration.

In particular, the invention also provides that one or more of the prophylactic or therapeutic agents, or pharmaceutical compositions of the invention is packaged in a hermetically sealed container such as an ampoule or sachette indicating the quantity of the agent. In one embodiment, one or more of the prophylactic or therapeutic agents, or pharmaceutical compositions of the invention is supplied as a dry sterilized lyophilized powder or water free concentrate in a hermetically sealed container and can be reconstituted (e.g., with water or saline) to the appropriate concentration for administration to a subject. Preferably, one or more of the prophylactic or therapeutic agents or pharmaceutical compositions of the invention is supplied as a dry sterile lyophilized powder in a hermetically sealed container at a unit dosage of at least 5 mg, more preferably at least 10 mg, at least 15 mg, at least 25 mg, at least 35 mg, at least 45 mg, at least 50 mg, at least 75 mg, or at least 100 mg. The lyophilized prophylactic or therapeutic agents or pharmaceutical compositions of the invention should be stored at between 2° C. and 8° C. in its original container and the prophylactic or therapeutic agents, or pharmaceutical compositions of the invention should be administered within 1 week, preferably within 5 days, within 72 hours, within 48 hours, within 24 hours, within 12 hours, within 6 hours, within 5 hours, within 3 hours, or within 1 hour after being reconstituted. In an alternative embodiment, one or more of the prophylactic or therapeutic agents or pharmaceutical compositions of the invention is supplied in liquid form in a hermetically sealed container indicating the quantity and concentration of the agent. Preferably, the liquid form of the administered composition is supplied in a hermetically sealed container at least 0.25 mg/ml, more preferably at least 0.5 mg/ml, at least 1 mg/ml, at least 2.5 mg/ml, at least 5 mg/ml, at least 8 mg/ml, at least 10 mg/ml, at least 15 mg/kg, at least 25 mg/ml, at least 50 mg/ml, at least 75 mg/ml or at least 100 mg/ml. The liquid form should be stored at between 2° C. and 8° C. in its original container.

The antibodies and antibody portions of the invention can be incorporated into a pharmaceutical composition suitable for parenteral administration. Preferably, the antibody or antibody-portions will be prepared as an injectable solution containing 0.1-250 mg/ml antibody. The injectable solution can be composed of either a liquid or lyophilized dosage form in a flint or amber vial, ampoule or pre-filled syringe. The buffer can be L-histidine (1-50 mM), optimally 5-10 mM, at pH 5.0 to 7.0 (optimally pH 6.0). Other suitable buffers include but are not limited to, sodium succinate, sodium citrate, sodium phosphate or potassium phosphate. Sodium chloride can be used to modify the toxicity of the solution at a concentration of 0-300 mM (optimally 150 mM for a liquid dosage form). Cryoprotectants can be included for a lyophilized dosage form, principally 0-10% sucrose (optimally 0.5-1.0%). Other suitable cryoprotectants include trehalose and lactose. Bulking agents can be included for a lyophilized dosage form, principally 1-10% mannitol (optimally 2-4%). Stabilizers can be used in both liquid and lyophilized dosage forms, principally 1-50 mM L-Methionine (optimally 5-10 mM). Other suitable bulking agents include glycine, arginine, can be included as 0-0.05% polysorbate-80 (optimally 0.005-0.01%). Additional surfactants include but are not limited to polysorbate 20 and BRIJ surfactants. The pharmaceutical composition comprising an antibody or antibody portion of the invention prepared as an injectable solution for parenteral administration, can further comprise an agent useful as an adjuvant, such as those used to increase the absorption, or dispersion of a therapeutic protein (e.g., antibody). A particularly useful adjuvant is hyaluronidase (such as Hylenex® recombinant human hyaluronidase). Addition of hyaluronidase in the injectable solution improves human bioavailability following parenteral administration, particularly subcutaneous administration. It also allows for greater injection site volumes (i.e. greater than 1 ml) with less pain and discomfort, and minimum incidence of injection site reactions (see, WO 2004/078140 and US patent application publication No. 2006104968).

The compositions of this invention may be in a variety of forms. These include, for example, liquid, semi-solid and solid dosage forms, such as liquid solutions (e.g., injectable and infusible solutions), dispersions or suspensions, tablets, pills, powders, liposomes and suppositories. The preferred form depends on the intended mode of administration and therapeutic application. Typical preferred compositions are in the form of injectable or infusible solutions, such as compositions similar to those used for passive immunization of humans with other antibodies. The preferred mode of administration is parenteral (e.g., intravenous, subcutaneous, intraperitoneal, intramuscular). In a preferred embodiment, the antibody is administered by intravenous infusion or injection. In another preferred embodiment, the antibody is administered by intramuscular or subcutaneous injection.

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound (i.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile, lyophilized powders for the preparation of sterile injectable solutions, the preferred methods of preparation are vacuum drying and spray-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including, in the composition, an agent that delays absorption, for example, monostearate salts and gelatin.

The antibodies and antibody-portions of the present invention can be administered by a variety of methods known in the art, although for many therapeutic applications, the preferred route/mode of administration is subcutaneous injection, intravenous injection or infusion. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., Sustained and Controlled Release Drug Delivery Systems, J. R. Robinson, ed., Marcel Dekker, Inc., New York, 1978.

In certain embodiments, an antibody or antibody portion of the invention may be orally administered, for example, with an inert diluent or an assimilable edible carrier. The compound (and other ingredients, if desired) may also be enclosed in a hard or soft shell gelatin capsule, compressed into tablets, or incorporated directly into the subject's diet. For oral therapeutic administration, the compounds may be incorporated with excipients and used in the form of ingestible tablets, buccal tablets, troches, capsules, elixirs, suspensions, syrups, wafers, and the like. To administer a compound of the invention by other than parenteral administration, it may be necessary to coat the compound with, or co-administer the compound with, a material to prevent its inactivation.

Supplementary active compounds can also be incorporated into the compositions. In certain embodiments, an antibody or antibody portion of the invention is coformulated with and/or coadministered with one or more additional therapeutic agents that are useful for treating disorders in which IL-17 activity is detrimental. For example, an anti-hIL-17 antibody or antibody portion of the invention may be coformulated and/or coadministered with one or more additional antibodies that bind other targets (e.g., antibodies that bind other cytokines or that bind cell surface molecules). Furthermore, one or more antibodies of the invention may be used in combination with two or more of the foregoing therapeutic agents. Such combination therapies may advantageously utilize lower dosages of the administered therapeutic agents, thus avoiding possible toxicities or complications associated with the various monotherapies.

In certain embodiments, an antibody to IL-17 or fragment thereof is linked to a half-life extending vehicle known in the art. Such vehicles include, but are not limited to, the Fc domain, polyethylene glycol, and dextran. Such vehicles are described, e.g., in U.S. Ser. No. 09/428,082 and published PCT Publication No. WO 99/25044, which are hereby incorporated by reference for any purpose.

In a specific embodiment, nucleic acid sequences comprising nucleotide sequences encoding an antibody of the invention or another prophylactic or therapeutic agent of the invention are administered to treat, prevent, manage, or ameliorate a disorder or one or more symptoms thereof by way of gene therapy. Gene therapy refers to therapy performed by the administration to a subject of an expressed or expressible nucleic acid. In this embodiment of the invention, the nucleic acids produce their encoded antibody or prophylactic or therapeutic agent of the invention that mediates a prophylactic or therapeutic effect.

Any of the methods for gene therapy available in the art can be used according to the present invention. For general reviews of the methods of gene therapy, see Goldspiel et al., 1993, *Clinical Pharmacy*, 12: 488-505; Wu et al., "Delivery systems for gene therapy," *Biotherapy*, 3: 87-95 (1991); Tolstoshev, 1993, *Ann. Rev. Pharmacol. Toxicol.*, 32: 573-596; Mulligan, *Science*, 260: 926-932 (1993); and Morgan and Anderson, "Human Gene Therapy," *Ann. Rev. Biochem.*, 62:191-217 (1993); Robinson, C., *Trends Biotechnol.*, 11:155 (1993). Methods commonly known in the art of recombinant DNA technology which can be used are described in Ausubel et al. (eds.), Current Protocols in Molecular Biology, John Wiley &Sons, NY (1993); and Kriegler, Gene Transfer and Expression, A Laboratory Manual, Stockton Press, NY (1990). Detailed description of various methods of gene therapy are disclosed in US application publication No. US 2005/0042664 A1, which is incorporated herein by reference.

IL-17 plays a critical role in the pathology associated with a variety of diseases involving immune and inflammatory elements. These diseases include, but are not limited to, Acquired Immunodeficiency Disease Syndrome; Acquired Immunodeficiency Related Diseases; acquired pernicious anaemia; Acute coronary syndromes; acute and chronic pain (different forms of pain); Acute Idiopathic Polyneuritis; acute immune disease associated with organ transplantation; acute or chronic immune disease associated with organ transplantation; Acute Inflammatory Demyelinating Polyradiculoneuropathy; Acute ischemia; acute liver disease; acute rheumatic fever; acute transverse myelitis; Addison's disease; adult (acute) respiratory distress syndrome; Adult Still's Disease; alcoholic cirrhosis; alcohol-induced liver injury; allergic diseases; allergy; alopecia; Alopecia greata; Alzheimer's disease; Anaphylaxis; ankylosing spondylitis; ankylosing spondylitis associated lung disease; Anti-Phospholipid Antibody Syndrome; Aplastic anemia; Arteriosclerosis; arthropathy; asthma; atheromatous disease/arteriosclerosis; atherosclerosis; atopic allergy; Atopic eczema; Atopic dermatitis; atrophic autoimmune hypothyroidism; autoimmune bullous disease; Autoimmune dermatitis; autoimmune diabetes; Autoimmune disorder associated with *Streptococcus* infection; Autoimmune Enteropathy; autoimmune haemolytic anaemia; autoimmune hepatitis; Autoimmune hearing loss; Autoimmune Lymphoproliferative Syndrome (ALPS); autoimmune mediated hypoglycaemia; Autoimmune myocarditis; autoimmune neutropenia; Autoimmune premature ovarian failure; autoimmune thrombocytopenia (AITP); autoimmune thyroid disease; autoimmune uveitis; bronchiolitis obliterans; Behcet's disease; Blepharitis; Bronchiectasis; Bullous pemphigoid; cachexia; Cardiovascular Disease; Catastrophic Antiphospholipid Syndrome; Celiac Disease; Cervical Spondylosis; chlamydia; choleosatatis; chronic active hepatitis; chronic eosinophilic pneumonia; chronic fatigue syndrome; chronic immune disease associated with organ transplantation; Chronic ischemia; chronic liver diseases; chronic mucocutaneous candidiasis; Cicatricial pemphigoid; Clinically isolated Syndrome (CIS) with Risk for Multiple Sclerosis; common varied immunodeficiency (common variable hypogammaglobulinaemia); connective tissue disease associated interstitial lung disease; Conjunctivitis; Coombs positive haemolytic anaemia; Childhood Onset Psychiatric Disorder; Chronic obstructive pulmonary disease (COPD); Crohn's disease; cryptogenic autoimmune hepatitis; cryptogenic fibrosing alveolitis; Dacryocystitis; depression; dermatitis scleroderma; dermatomyositis; dermatomyositis/polymyositis associated lung disease; Diabetic retinopathy; Diabetes mellitus; dilated cardiomyopathy; discoid lupus erythematosus; Disk herniation; Disk prolapse; disseminated intravascular coagulation; Drug-Induced hepatitis; drug-induced interstitial lung disease; Drug induced immune hemolytic anemia; Endocarditis; Endometriosis; endophthalmitis; enteropathic synovitis; Episcleritis; Erythema multiforme; erythema multiforme major; female infertility; fibrosis; fibrotic lung disease; Gestational pemphigoid; giant cell arteritis (GCA); glomerulonephritides; goitrous autoimmune hypothyroidism (Hashimoto's disease); Goodpasture's syndrome; gouty arthritis; graft versus host disease (GVHD); Grave's disease; group B streptococci (GBS) infection; Guillain-Barré Syndrome (GBS); haemosiderosis associated lung disease; Hay Fever; heart failure; hemolytic anemia; Henoch-Schoenlein purpurea; Hepatitis B; Hepatitis C; Hughes Syndrome; Huntington's chorea; hyperthyroidism; hypoparathyroidism; idiopathic leucopaenia; idiopathic thrombocytopaenia; Idiopathic Parkinson's Disease; idiopathic interstitial pneumonia; idiosyncratic liver disease; IgE-mediated Allergy; Immune hemolytic anemiae; Inclusion Body Myositis; infectious diseases; Infectious ocular inflammatory disease; inflammatory bowel disease; Inflammatory demyelinating disease; Inflammatory heart disease; Inflammatory kidney disease; insulin dependent diabetes mellitus; interstitial pneumonitis; IPF/UIP; Iritis; juvenile chronic arthritis; juvenile pernicious anaemia; Juvenile rheumatoid arthritis; Kawasaki's disease; Keratitis; Keratojunctivitis sicca; Kussmaul disease or Kussmaul-Meier Disease; Landry's Paralysis; Langerhan's Cell Histiocytosis; linear IgA disease; Livedo reticularis; Lyme arthritis; lymphocytic infiltrative lung disease; Macular Degeneration; male infertility idiopathic or NOS; malignancies; microscopic vasculitis of the kidneys; Microscopic Polyangiitis; mixed connective tissue disease associated lung disease; Morbus Bechterev; Motor Neuron Disorders; Mucous membrane pemphigoid; multiple sclerosis (all subtypes: primary progressive, secondary progressive, relapsing remitting etc.); Multiple Organ failure; myalgic encephalitis/Royal Free Disease; Myasthenia Gravis; Myelodysplastic Syndrome; myocardial infarction; Myocarditis; nephrotic syndrome; Nerve Root Disorders; Neuropathy; Non-alcoholic Steatohepatitis; Non-A Non-B Hepatitis; Optic Neuritis; organ transplant rejection; osteoarthritis; Osteolysis; Ovarian cancer; ovarian failure; Pancreatitis; Parasitic diseases; Parkinson's disease; Pauciarticular JRA; pemphigoid; pemphigus foliaceus; pemphigus vulgaris; peripheral artery occlusive disease (PAOD); peripheral vascular disease (PVD); peripheral artery disease (PAD); phacogenic uveitis; Phlebitis; Polyarteritis nodosa (or periarteritis nodosa); Polychondritis; Polymyalgia Rheumatica; Poliosis; Polyarticular JRA; Polyendocrine Deficiency Syndrome; Polymyositis; polyglandular deficiency type I and polyglandular deficiency type II; polymyalgia rheumatica (PMR); postinfectious interstitial lung disease; post-inflammatory interstitial lung disease; Post-Pump Syndrome; premature ovarian failure; primary biliary cirrhosis; primary myxoedema; primary parkinsonism; primary sclerosing cholangitis; primary sclerosing hepatitis; primary vasculitis; prostate and rectal cancer and hematopoietic malignancies (leukemia and lymphoma); Prostatitis; psoriasis; psoriasis type 1; psoriasis type 2; psoriatic arthritis; psoriatic arthropathy; pulmonary hypertension secondary to connective tissue disease; pulmonary manifestation of polyarteritis nodosa; Pure red cell aplasia; Primary Adrenal Insufficiency; radiation fibrosis; reactive arthritis; Reiter's disease; Recurrent Neuromyelitis Optica; renal disease NOS; Restenosis; rheumatoid arthritis; rheumatoid arthritis associated interstitial lung disease; Rheumatic heart disease; SAPHO (synovitis, acne, pustulosis, hyperostosis, and osteitis); sarcoidosis; Schizophreniae; Schmidt's syndrome; Scleroderma; Secondary Amyloidosis; Shock lung; Scleritis; Sciatica; Secondary Adrenal Insufficiency; sepsis syndrome; septic arthritis; septic shock; seronegative arthropathy; Silicone associated connective tissue disease; Sjögren's disease associated lung disease; Sjörgren's syndrome; Sneddon-Wilkinson Dermatosis; sperm autoimmunity; spondyloarthropathy; spondylitis ankylosans; Stevens-Johnson Syndrome (SJS); Still's disease; stroke; sympathetic ophthalmia; Systemic inflammatory response syndrome; systemic lupus erythematosus; systemic lupus erythematosus associated lung disease; systemic sclerosis; systemic sclerosis associated interstitial lung disease; Takayasu's disease/arteritis; Temporal arteritis; Th2 Type and Th1 Type mediated diseases; thyroiditis; toxic shock syndrome; toxoplasmic retinitis; toxic epidermal necrolysis; Transverse myelitis; TRAPS (Tumor-necrosis factor receptor type 1 (TNFR)-Associated Periodic Syndrome); type B insulin resistance with acanthosis nigricans; Type 1 allergic reaction; type-1 autoimmune hepatitis (classical autoimmune or lupoid hepatitis); type-2 autoimmune hepatitis (anti-LKM antibody hepatitis)e; Type II Diabetes; ulcerative colitic arthropathy; ulcerative colitis; Urticaria; Usual interstitial pneumonia (UIP); uveitis; vasculitic diffuse lung disease; Vasculitis; Vernal conjunctivitis; viral retinitis; vitiligo; Vogt-Koyanagi-Harada syndrome (VKH syndrome); Wegener's granulomatosis; Wet macular degeneration; Wound healing; *yersinia* and *salmonella* associated arthropathy.

The antibodies and antibody portions of the invention can be used to treat humans suffering from autoimmune diseases, in particular those associated with inflammation, rheumatoid arthritis (RA), osteoarthritis, psoriasis, multiple sclerosis (MS), and other autoimmune diseases.

An antibody or antibody portion of the invention also can be administered with one or more additional therapeutic agents useful in the treatment of autoimmune and inflammatory diseases.

In an embodiment, diseases that can be treated or diagnosed with the compositions and methods of the invention include, but are not limited to, primary and metastatic cancers, including carcinomas of breast, colon, rectum, lung, oropharynx, hypopharynx, esophagus, stomach, pancreas, liver, gallbladder and bile ducts, small intestine, urinary tract (including kidney, bladder and urothelium), female genital tract (including cervix, uterus, and ovaries as well as choriocarcinoma and gestational trophoblastic disease), male genital tract (including prostate, seminal vesicles, testes and germ cell tumors), endocrine glands (including the thyroid, adrenal, and pituitary glands), and skin, as well as hemangiomas, melanomas, sarcomas (including those arising from bone and soft tissues as well as Kaposi's sarcoma), tumors of the brain, nerves, eyes, and meninges (including astrocytomas, gliomas, glioblastomas, retinoblastomas, neuromas, neuroblastomas, Schwannomas, and meningiomas), solid tumors arising from hematopoietic malignancies such as leukemias, and lymphomas (both Hodgkin's and non-Hodgkin's lymphomas).

In another embodiment, an antibody of the invention or antigen binding portion thereof is used to treat cancer or in the prevention of metastases from a tumor. Such treatment may involve administration of the antibody or antigen binding portion thereof alone or in combination with another therapeutic agent or treatment, such as radiotherapy and/or a chemotherapeutic agent.

The antibodies of the invention, or antigen binding portions thereof, may be combined with agents that include but are not limited to, antineoplastic agents, radiotherapy, chemotherapy such as DNA alkylating agents, cisplatin, carboplatin, anti-tubulin agents, paclitaxel, docetaxel, taxol, doxorubicin, gemcitabine, gemzar, anthracyclines, adriamycin, topoisomerase I inhibitors, topoisomerase II inhibitors, 5-fluorouracil (5-FU), leucovorin, irinotecan, receptor tyrosine kinase inhibitors (e.g., erlotinib, gefitinib), COX-2 inhibitors (e.g., celecoxib), kinase inhibitors, and siRNAs.

A binding protein of the invention also can be administered with one or more additional therapeutic agents useful in the treatment of various diseases.

Antibodies of the invention, or antigen binding portions thereof, can be used alone or in combination to treat such diseases. It should be understood that the antibodies of the invention or antigen binding portion thereof can be used alone or in combination with an additional agent, e.g., a therapeutic agent, said additional agent being selected by the skilled artisan for its intended purpose. For example, the additional agent can be a therapeutic agent art-recognized as being useful to treat the disease or condition being treated by the antibody of the present invention. The additional agent also can be an agent that imparts a beneficial attribute to the therapeutic composition, e.g., an agent that affects the viscosity of the composition.

It should further be understood that the combinations which are to be included within this invention are those combinations useful for their intended purpose. The agents set forth below are illustrative for purposes and not intended to be limited. The combinations, which are part of this invention, can be the antibodies of the present invention and at least one additional agent selected from the lists below. The combination can also include more than one additional agent, e.g., two or three additional agents if the combination is such that the formed composition can perform its intended function.

Preferred combinations are non-steroidal anti-inflammatory drug(s) also referred to as NSAIDS which include drugs like ibuprofen. Other preferred combinations are corticosteroids including prednisolone; the well known side-effects of steroid use can be reduced or even eliminated by tapering the steroid dose required when treating patients in combination with the anti-IL-17 antibodies of this invention. Non-limiting examples of therapeutic agents for rheumatoid arthritis with which an antibody or antibody portion of the invention can be combined include, but are not limited to, the following: cytokine suppressive anti-inflammatory drug(s) (CSAIDs); antibodies to or antagonists of other human cytokines or growth factors, for example, TNF, LT, IL-1, IL-2, IL-3, IL-4, IL-5, IL-6, IL-7, IL-8, IL-15, IL-16, IL-18, IL-21, interferons, EMAP-II, GM-CSF, FGF, and PDGF. Antibodies of the invention, or antigen binding portions thereof, can be combined with antibodies to cell surface molecules such as CD2, CD3, CD4, CD8, CD25, CD28, CD30, CD40, CD45, CD69, CD80 (B7.1), CD86 (B7.2), CD90, CTLA or their ligands including CD154 (gp39 or CD40L).

Preferred combinations of therapeutic agents may interfere at different points in the autoimmune and subsequent inflammatory cascade; preferred examples include TNF antagonists like chimeric, humanized or human TNF antibodies, D2E7, (PCT Publication No. WO 97/29131), CA2 (Remicade™), CDP 571, and soluble p55 or p75 TNF receptors, derivatives, thereof, (p75TNFR1gG (Enbrel™) or p55TNFR1gG (Lenercept), and also TNFα converting enzyme (TACE) inhibitors; similarly IL-1 inhibitors (Interleukin-1-converting enzyme inhibitors, IL-1RA etc.) may be effective for the same reason. Other preferred combinations include Interleukin 11. Yet another preferred combination are other key players of the autoimmune response which may act parallel to, dependent on or in concert with IL-17 function. Yet another preferred combination are non-depleting anti-CD4 inhibitors. Yet other preferred combinations include antagonists of the co-stimulatory pathway CD80 (B7.1) or CD86 (B7.2) including antibodies, soluble receptors or antagonistic ligands.

The antibodies of the invention, or antigen binding portions thereof, may also be combined with agents, such as methotrexate, 6-MP, azathioprine sulphasalazine, mesalazine, olsalazine chloroquinine/hydroxychloroquine, pencillamine, aurothiomalate (intramuscular and oral), azathioprine, colchicine, corticosteroids (oral, inhaled and local injection), beta-2 adrenoreceptor agonists (salbutamol, terbutaline, salmeteral), xanthines (theophylline, aminophylline), cromoglycate, nedocromil, ketotifen, ipratropium and oxitropium, cyclosporin, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signaling by proinflammatory cytokines such as TNF-α or IL-1 (e.g., IRAK, NIK, IKK, p38, or MAP kinase inhibitors), IL-1β converting enzyme inhibitors, TNFα converting enzyme (TACE) inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g. soluble p55 or p75 TNF receptors and the derivatives p75TNFRIgG (Enbrel™ and p55TNFRIgG (Lenercept)), sIL-1RI, sIL-1R11, sIL-6R), antiinflammatory cytokines (e.g. IL-4, IL-10, IL-11, IL-13 and TGFβ), celecoxib, folic acid, hydroxychloroquine sulfate, rofecoxib, etanercept, infliximab, naproxen, valdecoxib, sulfasalazine, methylprednisolone, meloxicam, methylprednisolone acetate, gold sodium thiomalate, aspirin, triamcinolone acetonide, propoxyphene napsylate/apap, folate, nabumetone, diclofenac, piroxicam, etodolac, diclofenac sodium, oxaprozin, oxycodone hcl, hydrocodone bitartrate/apap, diclofenac sodium/misoprostol, fentanyl, anakinra, human recombinant, tramadol hcl, salsalate, sulindac, cyanocobalamin/fa/pyridoxine, acetaminophen, alendronate sodium, prednisolone, morphine sulfate, lidocaine hydrochloride, indomethacin, glucosamine sulf/chondroitin, amitriptyline hcl, sulfadiazine, oxycodone hcl/acetaminophen, olopatadine hcl, misoprostol, naproxen sodium, omeprazole, cyclophosphamide, rituximab, IL-1 TRAP, MRA, CTLA4-IG, IL-18 BP, anti-IL-18, Anti-IL15, BIRB-796, SCIO-469, VX-702, AMG-548, VX-740, Roflumilast, IC-485, CDC-801, and Mesopram. Preferred combinations include methotrexate or leflunomide and in moderate or severe rheumatoid arthritis cases, cyclosporine.

Non-limiting additional agents which can also be used in combination with a binding protein to treat rheumatoid arthritis (RA) include, but are not limited to, the following: non-steroidal anti-inflammatory drug(s) (NSAIDs); cytokine suppressive anti-inflammatory drug(s) (CSAIDs); CDP-571/BAY-10-3356 (humanized anti-TNFα antibody; Celltech/Bayer); cA2/infliximab (chimeric anti-TNFα antibody; Centocor); 75 kdTNFR-IgG/etanercept (75 kD TNF receptor-IgG fusion protein; Immunex; see e.g., *Arthritis & Rheumatism* (1994) Vol. 37, S295; *J. Invest. Med.* (1996) Vol. 44, 235A); 55 kd TNF-IgG (55 kD TNF receptor-IgG fusion protein; Hoffmann-LaRoche); IDEC-CE9.1/SB 210396 (non-depleting primatized anti-CD4 antibody; IDEC/SmithKline; see e.g., *Arthritis & Rheumatism* (1995) Vol. 38, S185); DAB 486-IL-2 and/or DAB 389-IL-2 (IL-2 fusion proteins; Seragen; see e.g., *Arthritis & Rheumatism* (1993) Vol. 36, 1223); Anti-Tac (humanized anti-IL-2Rα; Protein Design Labs/Roche); IL-4 (anti-inflammatory cytokine; DNAX/Schering); IL-10 (SCH 52000; recombinant IL-10, anti-inflammatory cytokine; DNAX/Schering); IL-4; IL-10 and/or IL-4 agonists (e.g., agonist antibodies); IL-1RA (IL-1 receptor antagonist; Synergen/Amgen); anakinra (Kineret®/Amgen); TNF-bp/s-TNF (soluble TNF binding protein; see e.g., *Arthritis & Rheumatism* (1996) Vol. 39, No. 9 (supplement), 5284; *Amer. J. Physiol.—Heart and Circulatory Physiology* (1995) Vol. 268, pp. 37-42); R973401 (phosphodiesterase Type IV inhibitor; see e.g., *Arthritis & Rheumatism* (1996) Vol. 39, No. 9 (supplement), S282); MK-966 (COX-2 Inhibitor; see e.g., *Arthritis & Rheumatism* (1996) Vol. 39, No. 9 (supplement), S81); Iloprost (see e.g., *Arthritis & Rheumatism* (1996) Vol. 39, No. 9 (supplement), S82); methotrexate; thalidomide (see e.g., *Arthritis & Rheumatism* (1996) Vol. 39, No. 9 (supplement), 5282) and thalidomide-related drugs (e.g., Celgen); leflunomide (anti-inflammatory and cytokine inhibitor; see e.g., *Arthritis & Rheumatism* (1996) Vol. 39, No. 9 (supplement), 5131; *Inflammation Research* (1996) Vol. 45, pp. 103-107); tranexamic acid (inhibitor of plasminogen activation; see e.g., *Arthritis & Rheumatism* (1996) Vol. 39, No. 9 (supplement), S284); T-614 (cytokine inhibitor; see e.g., *Arthritis & Rheumatism* (1996) Vol. 39, No. 9 (supplement), S282); prostaglandin E1 (see e.g., *Arthritis & Rheumatism* (1996) Vol. 39, No. 9 (supplement), S282); Tenidap (non-steroidal anti-inflammatory drug; see e.g., *Arthritis & Rheumatism* (1996) Vol. 39, No. 9 (supplement), S280); Naproxen (non-steroidal anti-inflammatory drug; see e.g., *Neuro Report* (1996) Vol. 7, pp. 1209-1213); Meloxicam (non-steroidal anti-inflammatory drug); Ibuprofen (non-steroidal anti-inflammatory drug); Piroxicam (non-steroidal anti-inflammatory drug); Diclofenac (non-steroidal anti-inflammatory drug); Indomethacin (non-steroidal anti-inflammatory drug); Sulfasalazine (see e.g., *Arthritis &*

*Rheumatism* (1996) Vol. 39, No. 9 (supplement), S281); Azathioprine (see e.g., *Arthritis & Rheumatism* (1996) Vol. 39, No. 9 (supplement), S281); ICE inhibitor (inhibitor of the enzyme interleukin-1β converting enzyme); zap-70 and/or lck inhibitor (inhibitor of the tyrosine kinase zap-70 or lck); VEGF inhibitor and/or VEGF-R inhibitor (inhibitors of vascular endothelial cell growth factor or vascular endothelial cell growth factor receptor; inhibitors of angiogenesis); corticosteroid anti-inflammatory drugs (e.g., SB203580); TNF-convertase inhibitors; anti-IL-12 antibodies; anti-IL-18 antibodies; interleukin-11 (see e.g., *Arthritis & Rheumatism* (1996) Vol. 39, No. 9 (supplement), S296); interleukin-13 (see e.g., *Arthritis & Rheumatism* (1996) Vol. 39, No. 9 (supplement), S308); interleukin-17 inhibitors (see e.g., *Arthritis & Rheumatism* (1996) Vol. 39, No. 9 (supplement), S120); gold; penicillamine; chloroquine; chlorambucil; hydroxychloroquine; cyclosporine; cyclophosphamide; total lymphoid irradiation; anti-thymocyte globulin; anti-CD4 antibodies; CD5-toxins; orally-administered peptides and collagen; lobenzarit disodium; Cytokine Regulating Agents (CRAs) HP228 and HP466 (Houghten Pharmaceuticals, Inc.); ICAM-1 antisense phosphorothioate oligo-deoxynucleotides (ISIS 2302; Isis Pharmaceuticals, Inc.); soluble complement receptor 1 (TP10; T Cell Sciences, Inc.); prednisone; orgotein; glycosaminoglycan polysulphate; minocycline; anti-IL2R antibodies; marine and botanical lipids (fish and plant seed fatty acids; see e.g., DeLuca et al. (1995) *Rheum. Dis. Clin. North Am.,* 21: 759-777); auranofin; phenylbutazone; meclofenamic acid; flufenamic acid; intravenous immune globulin; zileuton; azaribine; mycophenolic acid (RS-61443); tacrolimus (FK-506); sirolimus (rapamycin); amiprilose (therafectin); cladribine (2-chlorodeoxyadenosine); methotrexate; bcl-2 inhibitors (see Bruncko, Milan et al., Journal of Medicinal Chemistry (2007), 50(4), 641-662); antivirals and immune modulating agents.

In one embodiment, the binding protein or antigen-binding portion thereof, is administered in combination with one of the following agents for the treatment of rheumatoid arthritis (RA): small molecule inhibitor of KDR, small molecule inhibitor of Tie-2; methotrexate; prednisone; celecoxib; folic acid; hydroxychloroquine sulfate; rofecoxib; etanercept; infliximab; leflunomide; naproxen; valdecoxib; sulfasalazine; methylprednisolone; ibuprofen; meloxicam; methylprednisolone acetate; gold sodium thiomalate; aspirin; azathioprine; triamcinolone acetonide; propoxyphene napsylate/apap; folate; nabumetone; diclofenac; piroxicam; etodolac; diclofenac sodium; oxaprozin; oxycodone hcl; hydrocodone bitartrate/apap; diclofenac sodium/misoprostol; fentanyl; anakinra, human recombinant; tramadol hcl; salsalate; sulindac; cyanocobalamin/fa/pyridoxine; acetaminophen; alendronate sodium; prednisolone; morphine sulfate; lidocaine hydrochloride; indomethacin; glucosamine sulfate/chondroitin; cyclosporine; amitriptyline hcl; sulfadiazine; oxycodone hcl/acetaminophen; olopatadine hcl; misoprostol; naproxen sodium; omeprazole; mycophenolate mofetil; cyclophosphamide; rituximab; IL-1 TRAP; MRA; CTLA4-IG; IL-18 BP; IL-12/23; anti-IL 18; anti-IL 15; BIRB-796; SCIO-469; VX-702; AMG-548; VX-740; Roflumilast; IC-485; CDC-801; and mesopram.

Non-limiting examples of therapeutic agents for inflammatory bowel disease with which a binding protein of the invention can be combined include the following: budenoside; epidermal growth factor; corticosteroids; cyclosporin, sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1β mAbs; anti-IL-6 mAbs; growth factors; elastase inhibitors; pyridinyl-imidazole compounds; antibodies to or antagonists of other human cytokines or growth factors, for example, TNF, LT, IL-1, IL-2, IL-6, IL-7, IL-8, IL-15, IL-16, IL-17, IL-18, EMAP-II, GM-CSF, FGF, and PDGF. Antibodies of the invention, or antigen binding portions thereof, can be combined with antibodies to cell surface molecules such as CD2, CD3, CD4, CD8, CD25, CD28, CD30, CD40, CD45, CD69, CD90 or their ligands. The antibodies of the invention, or antigen binding portions thereof, may also be combined with agents, such as methotrexate, cyclosporin, FK506, rapamycin, mycophenolate mofetil, leflunomide, NSAIDs, for example, ibuprofen, corticosteroids such as prednisolone, phosphodiesterase inhibitors, adenosine agonists, antithrombotic agents, complement inhibitors, adrenergic agents, agents which interfere with signaling by proinflammatory cytokines such as TNFα or IL-1 (e.g., IRAK, NIK, IKK, p38 or MAP kinase inhibitors), IL-1β converting enzyme inhibitors, TNFα converting enzyme inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, sIL-6R) and antiinflammatory cytokines (e.g., IL-4, IL-10, IL-11, IL-13 and TGFβ) and bcl-2 inhibitors.

Examples of therapeutic agents for Crohn's disease in which a binding protein can be combined include the following: TNF antagonists, for example, anti-TNF antibodies, Adalimumab (PCT Publication No. WO 97/29131; HUMIRA®), CA2 (REMICADE), CDP 571, TNFR-Ig constructs, (p75TNFRIgG (ENBREL®) and p55TNFRIgG (LENERCEPT™)) inhibitors and PDE4 inhibitors. Antibodies of the invention, or antigen binding portions thereof, can be combined with corticosteroids, for example, budenoside and dexamethasone. Binding proteins of the invention or antigen binding portions thereof, may also be combined with agents such as sulfasalazine, 5-aminosalicylic acid and olsalazine, and agents which interfere with synthesis or action of proinflammatory cytokines such as IL-1, for example, IL-1β converting enzyme inhibitors and IL-1ra. Antibodies of the invention or antigen binding portion thereof may also be used with T cell signaling inhibitors, for example, tyrosine kinase inhibitors 6-mercaptopurines. Binding proteins of the invention, or antigen binding portions thereof, can be combined with IL-11. Binding proteins of the invention, or antigen binding portions thereof, can be combined with mesalamine, prednisone, azathioprine, mercaptopurine, infliximab, methylprednisolone sodium succinate, diphenoxylate/atrop sulfate, loperamide hydrochloride, methotrexate, omeprazole, folate, ciprofloxacin/dextrose-water, hydrocodone bitartrate/apap, tetracycline hydrochloride, fluocinonide, metronidazole, thimerosal/boric acid, cholestyramine/sucrose, ciprofloxacin hydrochloride, hyoscyamine sulfate, meperidine hydrochloride, midazolam hydrochloride, oxycodone hcl/acetaminophen, promethazine hydrochloride, sodium phosphate, sulfamethoxazole/trimethoprim, celecoxib, polycarbophil, propoxyphene napsylate, hydrocortisone, multivitamins, balsalazide disodium, codeine phosphate/apap, colesevelam hcl, cyanocobalamin, folic acid, levofloxacin, methylprednisolone, natalizumab and interferon-gamma Non-limiting examples of therapeutic agents for multiple sclerosis (MS) with which binding proteins of the invention can be combined include the following: corticosteroids; prednisolone; methylprednisolone; azathioprine; cyclophosphamide; cyclosporine; methotrexate; 4-aminopyridine; tizanidine; interferon-β1a (AVONEX; Biogen); interferon-β1b (BETASERON; Chiron/Berlex); interferon α-n3) (Interferon Sciences/Fujimoto), interferon-α (Alfa Wassermann/J&J), interferon β1A-IF (Serono/Inhale Therapeutics), Peginterferon α 2b (Enzon/Schering-Plough), Copolymer 1 (Cop-1; COPAXONE; Teva Pharmaceutical Industries, Inc.); hyperbaric oxygen; intravenous immunoglobulin; clabribine; antibodies to or antagonists of other human cytokines or growth factors and their receptors, for example, TNF, LT, IL-1, IL-2, IL-6, IL-7, IL-8, IL-23, IL-15, IL-16, IL-18, EMAP-II, GM-CSF, FGF, and PDGF. Binding proteins of the invention can be combined with antibodies to cell surface molecules such as CD2, CD3, CD4, CD8, CD19, CD20, CD25, CD28, CD30, CD40, CD45, CD69, CD80, CD86, CD90 or their ligands. Binding proteins of the invention, may also be combined with agents, such as methotrexate, cyclosporine, FK506, rapamycin, mycophenolate mofetil, leflunomide, NSAIDs, for example, ibuprofen, corticosteroids such as prednisolone, phosphodiesterase inhibitors, adensosine agonists, antithrombotic agents, complement inhibitors, adrenergic agents, agents which interfere with signaling by proinflammatory cytokines such as TNFα or IL-1 (e.g., IRAK, NIK, IKK, p38 or MAP kinase inhibitors), IL-1β converting enzyme inhibitors, TACE inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof (e.g., soluble p55 or p75 TNF receptors, sIL-1RI, sIL-1RII, sIL-6R), antiinflammatory cytokines (e.g., IL-4, IL-10, IL-13 and TGFβ) and bcl-2 inhibitors.

Examples of therapeutic agents for multiple sclerosis in which binding proteins of the invention can be combined to include interferon-β, for example, IFNβ1a and IFNβ1b; copaxone, corticosteroids, caspase inhibitors, for example inhibitors of caspase-1, IL-1 inhibitors, TNF inhibitors, and antibodies to CD40 ligand and CD80.

The binding proteins of the invention, may also be combined with agents, such as alemtuzumab, dronabinol, Unimed, daclizumab, mitoxantrone, xaliproden hydrochloride, fampridine, glatiramer acetate, natalizumab, sinnabidol, a-immunokine NNSO3, ABR-215062, AnergiX.MS, chemokine receptor antagonists, BBR-2778, calagualine, CPI-1189, LEM (liposome encapsulated mitoxantrone), THC.CBD (cannabinoid agonist) MBP-8298, mesopram (PDE4 inhibitor), MNA-715, anti-IL-6 receptor antibody, neurovax, pirfenidone allotrap 1258 (RDP-1258), sTNF-R1, talampanel, teriflunomide, TGF-beta2, tiplimotide, VLA-4 antagonists (for example, TR-14035, VLA4 Ultrahaler, Antegran-ELAN/Biogen), interferon gamma antagonists, IL-4 agonists.

Non-limiting examples of therapeutic agents for Angina with which binding proteins of the invention can be combined include the following: aspirin, nitroglycerin, isosorbide mononitrate, metoprolol succinate, atenolol, metoprolol tartrate, amlodipine besylate, diltiazem hydrochloride, isosorbide dinitrate, clopidogrel bisulfate, nifedipine, atorvastatin calcium, potassium chloride, furosemide, simvastatin, verapamil hcl, digoxin, propranolol hydrochloride, carvedilol, lisinopril, spironolactone, hydrochlorothiazide, enalapril maleate, nadolol, ramipril, enoxaparin sodium, heparin sodium, valsartan, sotalol hydrochloride, fenofibrate, ezetimibe, bumetanide, losartan potassium, lisinopril/hydrochlorothiazide, felodipine, captopril, bisoprolol fumarate.

Non-limiting examples of therapeutic agents for Ankylosing Spondylitis with which binding proteins of the invention can be combined include the following: ibuprofen, diclofenac and misoprostol, naproxen, meloxicam, indomethacin, diclofenac, celecoxib, rofecoxib, Sulfasalazine, Methotrexate, azathioprine, minocyclin, prednisone, etanercept, infliximab.

Non-limiting examples of therapeutic agents for Asthma with which binding proteins of the invention can be combined include the following: albuterol, salmeterol/fluticasone, montelukast sodium, fluticasone propionate, budesonide, prednisone, salmeterol xinafoate, levalbuterol hcl, albuterol sulfate/ipratropium, prednisolone sodium phosphate, triamcinolone acetonide, beclomethasone dipropionate, ipratropium bromide, azithromycin, pirbuterol acetate, prednisolone, theophylline anhydrous, methylprednisolone sodium succinate, clarithromycin, zafirlukast, formoterol fumarate, influenza virus vaccine, methylprednisolone, amoxicillin trihydrate, flunisolide, allergy injection, cromolyn sodium, fexofenadine hydrochloride, flunisolide/menthol, amoxicillin/clavulanate, levofloxacin, inhaler assist device, guaifenesin, dexamethasone sodium phosphate, moxifloxacin hcl, doxycycline hyclate, guaifenesin/d-methorphan, p-ephedrine/cod/chlorphenir, gatifloxacin, cetirizine hydrochloride, mometasone furoate, salmeterol xinafoate, benzonatate, cephalexin, pe/hydrocodone/chlorphenir, cetirizine hcl/pseudoephed, phenylephrine/cod/promethazine, codeine/promethazine, cefprozil, dexamethasone, guaifenesin/pseudoephedrine, chlorpheniramine/hydrocodone, nedocromil sodium, terbutaline sulfate, epinephrine, methylprednisolone, metaproterenol sulfate.

Non-limiting examples of therapeutic agents for COPD with which binding proteins of the invention can be combined include the following: albuterol sulfate/ipratropium, ipratropium bromide, salmeterol/fluticasone, albuterol, salmeterol xinafoate, fluticasone propionate, prednisone, theophylline anhydrous, methylprednisolone sodium succinate, montelukast sodium, budesonide, formoterol fumarate, triamcinolone acetonide, levofloxacin, guaifenesin, azithromycin, beclomethasone dipropionate, levalbuterol hcl, flunisolide, ceftriaxone sodium, amoxicillin trihydrate, gatifloxacin, zafirlukast, amoxicillin/clavulanate, flunisolide/menthol, chlorpheniramine/hydrocodone, metaproterenol sulfate, methylprednisolone, mometasone furoate, p-ephedrine/cod/chlorphenir, pirbuterol acetate, p-ephedrine/loratadine, terbutaline sulfate, tiotropium bromide, (R,R)-formoterol, TgAAT, Cilomilast, Roflumilast.

Non-limiting examples of therapeutic agents for HCV with which binding proteins of the invention can be combined include the following: Interferon-alpha-2a, Interferon-alpha-2b, Interferon-alpha con1, Interferon-alpha-n1, Pegylated interferon-alpha-2a, Pegylated interferon-alpha-2b, ribavirin, Peginterferon alfa-2b+ribavirin, Ursodeoxycholic Acid, Glycyrrhizic Acid, Thymalfasin, Maxamine, VX-497 and any compounds that are used to treat HCV through intervention with the following targets: HCV polymerase, HCV protease, HCV helicase, HCV IRES (internal ribosome entry site).

Non-limiting examples of therapeutic agents for Idiopathic Pulmonary Fibrosis with which binding proteins of the invention can be combined include the following: prednisone, azathioprine, albuterol, colchicine, albuterol sulfate, digoxin, gamma interferon, methylprednisolone sod succ, lorazepam, furosemide, lisinopril, nitroglycerin, spironolactone, cyclophosphamide, ipratropium bromide, actinomycin d, alteplase, fluticasone propionate, levofloxacin, metaproterenol sulfate, morphine sulfate, oxycodone hcl, potassium chloride, triamcinolone acetonide, tacrolimus anhydrous, calcium, interferon-alpha, methotrexate, mycophenolate mofetil, Interferon-gamma-1β.

Non-limiting examples of therapeutic agents for Myocardial Infarction with which binding proteins of the invention can be combined include the following: aspirin, nitroglycerin, metoprolol tartrate, enoxaparin sodium, heparin sodium, clopidogrel bisulfate, carvedilol, atenolol, morphine sulfate, metoprolol succinate, warfarin sodium, lisinopril, isosorbide mononitrate, digoxin, furosemide, simvastatin, ramipril, tenecteplase, enalapril maleate, torsemide, retavase, losartan potassium, quinapril hcl/mag carb, bumetanide, alteplase, enalaprilat, amiodarone hydrochloride, tirofiban hcl m-hydrate, diltiazem hydrochloride, captopril, irbesartan, valsartan, propranolol hydrochloride, fosinopril sodium, lidocaine hydrochloride, eptifibatide, cefazolin sodium, atropine sulfate, aminocaproic acid, spironolactone, interferon, sotalol hydrochloride, potassium chloride, docusate sodium, dobutamine hcl, alprazolam, pravastatin sodium, atorvastatin calcium, midazolam hydrochloride, meperidine hydrochloride, isosorbide dinitrate, epinephrine, dopamine hydrochloride, bivalirudin, rosuvastatin, ezetimibe/simvastatin, avasimibe, cariporide.

Non-limiting examples of therapeutic agents for Psoriasis with which binding proteins of the invention can be combined include the following: small molecule inhibitor of KDR, small molecule inhibitor of Tie-2, calcipotriene, clobetasol propionate, triamcinolone acetonide, halobetasol propionate, tazarotene, methotrexate, fluocinonide, betamethasone diprop augmented, fluocinolone acetonide, acitretin, tar shampoo, betamethasone valerate, mometasone furoate, ketoconazole, pramoxine/fluocinolone, hydrocortisone valerate, flurandrenolide, urea, betamethasone, clobetasol propionate/emoll, fluticasone propionate, azithromycin, hydrocortisone, moisturizing formula, folic acid, desonide, pimecrolimus, coal tar, diflorasone diacetate, etanercept folate, lactic acid, methoxsalen, hc/bismuth subgal/znox/resor, methylprednisolone acetate, prednisone, sunscreen, halcinonide, salicylic acid, anthralin, clocortolone pivalate, coal extract, coal tar/salicylic acid, coal tar/salicylic acid/sulfur, desoximetasone, diazepam, emollient, fluocinonide/emollient, mineral oil/castor oil/na lact, mineral oil/peanut oil, petroleum/isopropyl myristate, psoralen, salicylic acid, soap/tribromsalan, thimerosal/boric acid, celecoxib, infliximab, cyclosporine, alefacept, efalizumab, tacrolimus, pimecrolimus, PUVA, UVB, sulfasalazine.

Non-limiting examples of therapeutic agents for Psoriatic Arthritis with which binding proteins of the invention can be combined include the following: methotrexate, etanercept, rofecoxib, celecoxib, folic acid, sulfasalazine, naproxen, leflunomide, methylprednisolone acetate, indomethacin, hydroxychloroquine sulfate, prednisone, sulindac, betamethasone diprop augmented, infliximab, methotrexate, folate, triamcinolone acetonide, diclofenac, dimethylsulfoxide, piroxicam, diclofenac sodium, ketoprofen, meloxicam, methylprednisolone, nabumetone, tolmetin sodium, calcipotriene, cyclosporine, diclofenac sodium/misoprostol, fluocinonide, glucosamine sulfate, gold sodium thiomalate, hydrocodone bitartrate/apap, ibuprofen, risedronate sodium, sulfadiazine, thioguanine, valdecoxib, alefacept, efalizumab and bcl-2 inhibitors.

Non-limiting examples of therapeutic agents for Restenosis with which binding proteins of the invention can be combined include the following: sirolimus, paclitaxel, everolimus, tacrolimus, Zotarolimus, acetaminophen.

Non-limiting examples of therapeutic agents for Sciatica with which binding proteins of the invention can be combined include the following: hydrocodone bitartrate/apap, rofecoxib, cyclobenzaprine hcl, methylprednisolone, naproxen, ibuprofen, oxycodone hcl/acetaminophen, celecoxib, valdecoxib, methylprednisolone acetate, prednisone, codeine phosphate/apap, tramadol hcl/acetaminophen, metaxalone, meloxicam, methocarbamol, lidocaine hydrochloride, diclofenac sodium, gabapentin, dexamethasone, carisoprodol, ketorolac tromethamine, indomethacin, acetaminophen, diazepam, nabumetone, oxycodone hcl, tizanidine hcl, diclofenac sodium/misoprostol, propoxyphene napsylate/apap, asa/oxycod/oxycodone ter, ibuprofen/hydrocodone bit, tramadol hcl, etodolac, propoxyphene hcl, amitriptyline hcl, carisoprodol/codeine phos/asa, morphine sulfate, multivitamins, naproxen sodium, orphenadrine citrate, temazepam.

Examples of therapeutic agents for SLE (Lupus) in which binding proteins of the invention can be combined include the following: NSAIDS, for example, diclofenac, naproxen, ibuprofen, piroxicam, indomethacin; COX2 inhibitors, for example, Celecoxib, rofecoxib, valdecoxib; anti-malarials, for example, hydroxychloroquine; Steroids, for example, prednisone, prednisolone, budenoside, dexamethasone; Cytotoxics, for example, azathioprine, cyclophosphamide, mycophenolate mofetil, methotrexate; inhibitors of PDE4 or purine synthesis inhibitor, for example Cellcept. Binding proteins of the invention, may also be combined with agents such as sulfasalazine, 5-aminosalicylic acid, olsalazine, Imuran and agents which interfere with synthesis, production or action of proinflammatory cytokines such as IL-1, for example, caspase inhibitors like IL-1β converting enzyme inhibitors and IL-1ra. Binding proteins of the invention may also be used with T cell signaling inhibitors, for example, tyrosine kinase inhibitors; or molecules that target T cell activation molecules, for example, CTLA-4-IgG or anti-B7 family antibodies, anti-PD-1 family antibodies. Binding proteins of the invention, can be combined with IL-11 or anti-cytokine antibodies, for example, fonotolizumab (anti-IFNg antibody), or anti-receptor receptor antibodies, for example, anti-IL-6 receptor antibody and antibodies to B-cell surface molecules. Antibodies of the invention or antigen binding portion thereof may also be used with LJP 394 (abetimus), agents that deplete or inactivate B-cells, for example, Rituximab (anti-CD20 antibody), lymphostat-B (anti-BlyS antibody), TNF antagonists, for example, anti-TNF antibodies, Adalimumab (PCT Publication No. WO 97/29131; HUMIRA®), CA2 (REMICADE®), CDP 571, TNFR-Ig constructs, (p75TNFRIgG (ENBREL®) and p55TNFRIgG (LENERCEPT®)) and bcl-2 inhibitors, because bcl-2 overexpression in transgenic mice has been demonstrated to cause a lupus like phenotype (see Marquina, Regina et al., Journal of Immunology (2004), 172(11), 7177-7185), therefore inhibition is expected to have therapeutic effects.

The pharmaceutical compositions of the invention may include a "therapeutically effective amount" or a "prophylactically effective amount" of an antibody or antibody portion of the invention. A "therapeutically effective amount" refers to an amount effective, at dosages and for periods of time necessary, to achieve the desired therapeutic result. A therapeutically effective amount of the antibody or antibody portion may be determined by a person skilled in the art and may vary according to factors such as the disease state, age, sex, and weight of the individual, and the ability of the antibody or antibody portion to elicit a desired response in the individual. A therapeutically effective amount is also one in which any toxic or detrimental effects of the antibody, or antibody portion, are outweighed by the therapeutically beneficial effects. A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic or prophylactic effect to be achieved, and (b) the limitations inherent in the art of compounding such an active compound for the treatment of sensitivity in individuals.

It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed composition.

Diagnostics

The disclosure herein also provides diagnostic applications. This is further elucidated below. Antibodies that bind IL-17 and/or IL-17F of the invention may be employed in any of a variety of formats to detect IL-17 and/or IL-17F in vivo, in vitro, or ex vivo (i.e., in cells or tissues that have been obtained from a living individual, subjected to a procedure, then returned to the individual). DVD-Igs of the invention offer the further advantage of being capable of binding to an epitope of IL-17 as well as other antigens or epitopes in various diagnostic and detection assay formats.

I. Method of Assay

The present disclosure also provides a method for determining the presence, amount or concentration of an IL-17, or a fragment thereof, ("analyte") in a test sample using at least one anti-IL-17 binding protein or antigen binding portion thereof, including a DVD-Ig, as described herein. Any suitable assay as is known in the art can be used in the method. Examples include, but are not limited to, immunoassay, such as sandwich immunoassay (e.g., monoclonal, polyclonal and/or DVD-Ig sandwich immunoassays or any variation thereof (e.g., monoclonal/DVD-Ig, DVD-Ig/polyclonal, etc.), including radioisotope detection (radioimmunoassay (RIA)) and enzyme detection (enzyme immunoassay (EIA) or enzyme-linked immunosorbent assay (ELISA) (e.g., Quantikine ELISA assays, R&D Systems, Minneapolis, Minn.))), competitive inhibition immunoassay (e.g., forward and reverse), fluorescence polarization immunoassay (FPIA), enzyme multiplied immunoassay technique (EMIT), bioluminescence resonance energy transfer (BRET), and homogeneous chemiluminescent assay, etc. In a SELDI-based immunoassay, a capture reagent that specifically binds an analyte (or a fragment thereof) of interest is attached to the surface of a mass spectrometry probe, such as a pre-activated protein chip array. The analyte (or a fragment thereof) is then specifically captured on the biochip, and the captured analyte (or a fragment thereof) is detected by mass spectrometry. Alternatively, the analyte (or a fragment thereof) can be eluted from the capture reagent and detected by traditional MALDI (matrix-assisted laser desorption/ionization) or by SELDI. A chemiluminescent microparticle immunoassay, in particular one employing the ARCHITECT® automated analyzer (Abbott Laboratories, Abbott Park, Ill.), is an example of a preferred immunoassay.

Methods well-known in the art for collecting, handling and processing urine, blood, serum and plasma, and other body fluids, are used in the practice of the present disclosure, for instance, when anti-IL-17 binding protein as described herein is employed as an immunodiagnostic reagent and/or in an analyte immunoassay kit. The test sample can comprise further moieties in addition to the analyte of interest, such as antibodies, antigens, haptens, hormones, drugs, enzymes, receptors, proteins, peptides, polypeptides, oligonucleotides and/or polynucleotides. For example, the sample can be a whole blood sample obtained from a subject. It can be necessary or desired that a test sample, particularly whole blood, be treated prior to immunoassay as described herein, e.g., with a pretreatment reagent. Even in cases where pretreatment is not necessary (e.g., most urine samples), pretreatment optionally can be done (e.g., as part of a regimen on a commercial platform).

The pretreatment reagent can be any reagent appropriate for use with the immunoassay and kits of the invention. The pretreatment optionally comprises: (a) one or more solvents (e.g., methanol and ethylene glycol) and optionally, salt, (b) one or more solvents and salt, and optionally, detergent, (c) detergent, or (d) detergent and salt. Pretreatment reagents are known in the art, and such pretreatment can be employed, e.g., as used for assays on Abbott TDx, AxSYM®, and ARCHITECT® analyzers (Abbott Laboratories, Abbott Park, Ill.), as described in the literature (see, e.g., Yatscoff et al., Abbott TDx Monoclonal Antibody Assay Evaluated for Measuring Cyclosporine in Whole Blood, Clin. Chem. 36: 1969-1973 (1990), and Wallemacq et al., Evaluation of the New AxSYM Cyclosporine Assay: Comparison with TDx Monoclonal Whole Blood and EMIT Cyclosporine Assays, Clin. Chem. 45: 432-435 (1999)), and/or as commercially available. Additionally, pretreatment can be done as described in Abbott's U.S. Pat. No. 5,135,875; European Patent Publication No. 0 471 293; PCT Publication No. WO 2008/082984; and US Patent Application Publication No. 2008/0020401 (incorporated by reference in its entirety for its teachings regarding pretreatment). The pretreatment reagent can be a heterogeneous agent or a homogeneous agent.

With use of a heterogeneous pretreatment reagent, the pretreatment reagent precipitates analyte binding protein (e.g., protein that can bind to an analyte or a fragment thereof) present in the sample. Such a pretreatment step comprises removing any analyte binding protein by separating from the precipitated analyte binding protein the supernatant of the mixture formed by addition of the pretreatment agent to sample. In such an assay, the supernatant of the mixture absent any binding protein is used in the assay, proceeding directly to the antibody capture step.

With use of a homogeneous pretreatment reagent there is no such separation step. The entire mixture of test sample and pretreatment reagent are contacted with a labeled specific binding partner for analyte (or a fragment thereof), such as a labeled anti-analyte antibody (or an antigenically reactive fragment thereof). The pretreatment reagent employed for such an assay typically is diluted in the pretreated test sample mixture, either before or during capture by the first specific binding partner. Despite such dilution, a certain amount of the pretreatment reagent is still present (or remains) in the test sample mixture during capture. According to the invention, a preferred labeled specific binding partner can be a DVD-Ig (or a fragment, a variant, or a fragment of a variant thereof).

In a heterogeneous format, after the test sample is obtained from a subject, a first mixture is prepared. The mixture contains the test sample being assessed for an analyte (or a fragment thereof) and a first specific binding partner, wherein the first specific binding partner and any analyte contained in the test sample form a first specific binding partner-analyte complex. Preferably, the first specific binding partner is an anti-analyte antibody or a fragment thereof. The first specific binding partner can be a DVD-Ig (or a fragment, a variant, or a fragment of a variant thereof) as described herein. The order in which the test sample and the first specific binding partner are added to form the mixture is not critical. Preferably, the first specific binding partner is immobilized on a solid phase. The solid phase used in the immunoassay (for the first specific binding partner and, optionally, the second specific binding partner) can be any solid phase known in the art, such as, but not limited to, a magnetic particle, a bead, a test tube, a microtiter plate, a cuvette, a membrane, a scaffolding molecule, a film, a filter paper, a disc and a chip.

After the mixture containing the first specific binding partner-analyte complex is formed, any unbound analyte is removed from the complex using any technique known in the art. For example, the unbound analyte can be removed by washing. Desirably, however, the first specific binding partner is present in excess of any analyte present in the test sample, such that all analyte that is present in the test sample is bound by the first specific binding partner.

After any unbound analyte is removed, a second specific binding partner is added to the mixture to form a first specific binding partner-analyte-second specific binding partner complex. The second specific binding partner is preferably an anti-analyte antibody that binds to an epitope on analyte that differs from the epitope on analyte bound by the first specific binding partner. Moreover, also preferably, the second specific binding partner is labeled with or contains a detectable label as described above. The second specific binding partner can be a DVD-Ig (or a fragment, a variant, or a fragment of a variant thereof) as described herein.

Any suitable detectable label as is known in the art can be used. For example, the detectable label can be a radioactive label (such as $^3H$, $^{125}I$, $^{35}S$, $^{14}C$, $^{32}P$, and $^{33}P$), an enzymatic label (such as horseradish peroxidase, alkaline peroxidase, glucose 6-phosphate dehydrogenase, and the like), a chemiluminescent label (such as acridinium esters, thioesters, or sulfonamides; luminol, isoluminol, phenanthridinium esters, and the like), a fluorescent label (such as fluorescein (e.g., 5-fluorescein, 6-carboxyfluorescein, 3'6-carboxyfluorescein, 5(6)-carboxyfluorescein, 6-hexachloro-fluorescein, 6-tetrachlorofluorescein, fluorescein isothiocyanate, and the like)), rhodamine, phycobiliproteins, R-phycoerythrin, quantum dots (e.g., zinc sulfide-capped cadmium selenide), a thermometric label, or an immuno-polymerase chain reaction label. An introduction to labels, labeling procedures and detection of labels is found in Polak and Van Noorden, Introduction to Immunocytochemistry, 2nd ed., Springer Verlag, N.Y. (1997), and in Haugland, Handbook of Fluorescent Probes and Research Chemicals (1996), which is a combined handbook and catalogue published by Molecular Probes, Inc., Eugene, Oreg. A fluorescent label can be used in FPIA (see, e.g., U.S. Pat. Nos. 5,593,896, 5,573,904, 5,496,925, 5,359,093, and 5,352,803). An acridinium compound can be used as a detectable label in a homogeneous or heterogeneous chemiluminescent assay (see, e.g., Adamczyk et al., Bioorg. Med. Chem. Lett. 16: 1324-1328 (2006); Adamczyk et al., Bioorg. Med. Chem. Lett. 4: 2313-2317 (2004); Adamczyk et al., Biorg. Med. Chem. Lett. 14: 3917-3921 (2004); and Adamczyk et al., Org. Lett. 5: 3779-3782 (2003)).

A preferred acridinium compound is an acridinium-9-carboxamide. Methods for preparing acridinium 9-carboxamides are described in Mattingly, J. Biolumin. Chemilumin. 6: 107-114 (1991); Adamczyk et al., J. Org. Chem., 63: 5636-5639 (1998); Adamczyk et al., Tetrahedron, 55: 10899-10914 (1999); Adamczyk et al., Org. Lett., 1: 779-781 (1999); Adamczyk et al., Bioconjugate Chem., 11: 714-724 (2000); Mattingly et al., In Luminescence Biotechnology: Instruments and Applications; Dyke, K. V. Ed.; CRC Press: Boca Raton, pp. 77-105 (2002); Adamczyk et al., Org. Lett., 5: 3779-3782 (2003); and U.S. Pat. Nos. 5,468,646, 5,543,524 and 5,783,699. Another preferred acridinium compound is an acridinium-9-carboxylate aryl ester. An example of an acridinium-9-carboxylate aryl ester is 10-methyl-9-(phenoxycarbonyl)acridinium fluorosulfonate (available from Cayman Chemical, Ann Arbor, Mich.). Methods for preparing acridinium 9-carboxylate aryl esters are described in McCapra et al., Photochem. Photobiol., 4: 1111-21 (1965); Razavi et al., Luminescence, 15: 245-249 (2000); Razavi et al., Luminescence, 15: 239-244 (2000); and U.S. Pat. No. 5,241,070. Further details regarding acridinium-9-carboxylate aryl ester and its use are set forth in US 2008-0248493.

Chemiluminescent assays (e.g., using acridinium as described above or other chemiluminescent agents) can be performed in accordance with the methods described in Adamczyk et al., Anal. Chim. Acta, 579(1): 61-67 (2006). While any suitable assay format can be used, a microplate chemiluminometer (Mithras LB-940, Berthold Technologies U.S.A., LLC, Oak Ridge, Tenn.) enables the assay of multiple samples of small volumes rapidly.

The order in which the test sample and the specific binding partner(s) are added to form the mixture for chemiluminescent assay is not critical. If the first specific binding partner is detectably labeled with a chemiluminescent agent such as an acridinium compound, detectably labeled first specific binding partner-analyte complexes form. Alternatively, if a second specific binding partner is used and the second specific binding partner is detectably labeled with a chemiluminescent agent such as an acridinium compound, detectably labeled first specific binding partner-analyte-second specific binding partner complexes form. Any unbound specific binding partner, whether labeled or unlabeled, can be removed from the mixture using any technique known in the art, such as washing.

Hydrogen peroxide can be generated in situ in the mixture or provided or supplied to the mixture (e.g., the source of the hydrogen peroxide being one or more buffers or other solutions that are known to contain hydrogen peroxide) before, simultaneously with, or after the addition of an above-described acridinium compound. Hydrogen peroxide can be generated in situ in a number of ways such as would be apparent to one skilled in the art.

Upon the simultaneous or subsequent addition of at least one basic solution to the sample, a detectable signal, namely, a chemiluminescent signal, indicative of the presence of analyte is generated. The basic solution contains at least one base and has a pH greater than or equal to 10, preferably, greater than or equal to 12. Examples of basic solutions include, but are not limited to, sodium hydroxide, potassium hydroxide, calcium hydroxide, ammonium hydroxide, magnesium hydroxide, sodium carbonate, sodium bicarbonate, calcium hydroxide, calcium carbonate, and calcium bicarbonate. The amount of basic solution added to the sample depends on the concentration of the basic solution. Based on the concentration of the basic solution used, one skilled in the art can easily determine the amount of basic solution to add to the sample.

The chemiluminescent signal that is generated can be detected using routine techniques known to those skilled in the art. Based on the intensity of the signal generated, the amount of analyte in the sample can be quantified. Specifically, the amount of analyte in the sample is proportional to the intensity of the signal generated. The amount of analyte present can be quantified by comparing the amount of light generated to a standard curve for analyte or by comparison to a reference standard. The standard curve can be generated using serial dilutions or solutions of known concentrations of analyte by mass spectroscopy, gravimetric methods, and other techniques known in the art. While the above is described with emphasis on use of an acridinium compound as the chemiluminescent agent, one of ordinary skill in the art can readily adapt this description for use of other chemiluminescent agents.

Analyte immunoassays generally can be conducted using any format known in the art, such as, but not limited to, a sandwich format. Specifically, in one immunoassay format, at least two antibodies are employed to separate and quantify analyte, such as human analyte, or a fragment thereof in a sample. More specifically, the at least two antibodies bind to different epitopes on an analyte (or a fragment thereof) forming an immune complex, which is referred to as a "sandwich." Generally, in the immunoassays one or more antibodies can be used to capture the analyte (or a fragment thereof) in the test sample (these antibodies are frequently referred to as a "capture" antibody or "capture" antibodies) and one or more antibodies can be used to bind a detectable (namely, quantifiable) label to the sandwich (these antibodies are frequently referred to as the "detection antibody," the "detection antibodies," the "conjugate," or the "conjugates"). Thus, in the context of a sandwich immunoassay format, a DVD-Ig (or a fragment, a variant, or a fragment of a variant thereof) as described herein can be used as a capture antibody, a detection antibody, or both. For example, one DVD-Ig having a domain that can bind a first epitope on an analyte (or a fragment thereof) can be used as a capture antibody and/or another DVD-Ig having a domain that can bind a second epitope on an analyte (or a fragment thereof) can be used as a detection antibody. In this regard, a DVD-Ig having a first domain that can bind a first epitope on an analyte (or a fragment thereof) and a second domain that can bind a second epitope on an analyte (or a fragment thereof) can be used as a capture antibody and/or a detection antibody. Alternatively, one DVD-Ig having a first domain that can bind an epitope on a first analyte (or a fragment thereof) and a second domain that can bind an epitope on a second analyte (or a fragment thereof) can be used as a capture antibody and/or a detection antibody to detect, and optionally quantify, two or more analytes. In the event that an analyte can be present in a sample in more than one form, such as a monomeric form and a dimeric/multimeric form, which can be homomeric or heteromeric, one DVD-Ig having a domain that can bind an epitope that is only exposed on the monomeric form and another DVD-Ig having a domain that can bind an epitope on a different part of a dimeric/multimeric form can be used as capture antibodies and/or detection antibodies, thereby enabling the detection, and optional quantification, of different forms of a given analyte. Furthermore, employing DVD-Igs with differential affinities within a single DVD-Ig and/or between DVD-Igs can provide an avidity advantage. In the context of immunoassays as described herein, it generally may be helpful or desired to incorporate one or more linkers within the structure of a DVD-Ig. When present, optimally the linker should be of sufficient length and structural flexibility to enable binding of an epitope by the inner domains as well as binding of another epitope by the outer domains. In this regard, if a DVD-Ig can bind two different analytes and one analyte is larger than the other, desirably the larger analyte is bound by the outer domains.

Generally speaking, a sample being tested for (for example, suspected of containing) an IL-17 protein (or a fragment thereof) can be contacted with at least one capture antibody (or antibodies) and at least one detection antibody (which can be a second detection antibody or a third detection antibody or even a successively numbered antibody, e.g., as where the capture and/or detection antibody comprise multiple antibodies) either simultaneously or sequentially and in any order. For example, the test sample can be first contacted with at least one capture antibody and then (sequentially) with at least one detection antibody. Alternatively, the test sample can be first contacted with at least one detection antibody and then (sequentially) with at least one capture antibody. In yet another alternative, the test sample can be contacted simultaneously with a capture antibody and a detection antibody.

In the sandwich assay format, a sample suspected of containing IL-17 (or a fragment thereof) is first brought into contact with at least one first capture binding protein (e.g., IL-17 antibody) under conditions that allow the formation of a first binding protein/IL-17 complex. If more than one capture binding protein is used, a first capture binding protein/IL-17 complex comprising two or more capture binding proteins forms. In a sandwich assay, the binding proteins, i.e., preferably, the at least one capture binding protein, are used in molar excess amounts of the maximum amount of IL-17 analyte (or a fragment thereof) expected in the test sample. For example, from about 5 μg to about 1 mg of antibody per mL of buffer (e.g., microparticle coating buffer) can be used.

Competitive inhibition immunoassays, which are often used to measure small analytes because binding by only one antibody is required, comprise sequential and classic formats. In a sequential competitive inhibition immunoassay a capture binding protein to IL-17 is coated onto a well of a microtiter plate or other solid support. When the sample containing the IL-17 is added to the well, the IL-17 binds to the capture binding protein. After washing, a known amount of labeled (e.g., biotin or horseradish peroxidase (HRP)) IL-17 is added to the well. A substrate for an enzymatic label is necessary to generate a signal. An example of a suitable substrate for HRP is 3,3',5,5'-tetramethylbenzidine (TMB). After washing, the signal generated by the labeled analyte is measured and is inversely proportional to the amount of IL-17 in the sample. In a classic competitive inhibition immunoassay, a binding protein to IL-17 is coated onto a solid support (e.g., a well of a microtiter plate). However, unlike the sequential competitive inhibition immunoassay, the sample and the labeled IL-17 are added to the well at the same time. Any IL-17 in the sample competes with labeled IL-17 for binding to the capture binding protein. After washing, the signal generated by the labeled IL-17 is measured and is inversely proportional to the amount of IL-17 in the sample.

Optionally, prior to contacting the test sample with the at least one capture binding protein (for example, the first capture antibody), the at least one capture binding protein can be bound to a solid support, which facilitates the separation of the first binding protein/IL-17 (or a fragment thereof) complex from the test sample. The substrate to which the capture binding protein is bound can be any suitable solid support or solid phase that facilitates separation of the capture antibody-analyte complex from the sample.

Examples include a well of a plate, such as a microtiter plate, a test tube, a porous gel (e.g., silica gel, agarose, dextran, or gelatin), a polymeric film (e.g., polyacrylamide), beads (e.g., polystyrene beads or magnetic beads), a strip of a filter/membrane (e.g., nitrocellulose or nylon), microparticles (e.g., latex particles, magnetizable microparticles (e.g., microparticles having ferric oxide or chromium oxide cores and homo- or hetero-polymeric coats and radii of about 1-10 microns). The substrate can comprise a suitable porous material with a suitable surface affinity to bind antigens and sufficient porosity to allow access by detection antibodies. A microporous material is generally preferred, although a gelatinous material in a hydrated state can be used. Such porous substrates are preferably in the form of sheets having a thickness of about 0.01 to about 0.5 mm, preferably about 0.1 mm. While the pore size may vary quite a bit, preferably the pore size is from about 0.025 to about 15 microns, more preferably from about 0.15 to about 15 microns. The surface of such substrates can be activated by chemical processes that cause covalent linkage of an antibody to the substrate. Irreversible binding, generally by adsorption through hydrophobic forces, of the antigen or the antibody to the substrate results; alternatively, a chemical coupling agent or other means can be used to bind covalently the antibody to the substrate, provided that such binding does not interfere with the ability of the antibody to bind to analyte. Alternatively, the antibody can be bound with microparticles, which have been previously coated with streptavidin (e.g., DYNAL® Magnetic Beads, Invitrogen, Carlsbad, Calif.) or biotin (e.g., using Power-Bind™-SA-MP streptavidin-coated microparticles (Seradyn, Indianapolis, Ind.)) or anti-species-specific monoclonal antibodies. If necessary, the substrate can be derivatized to allow reactivity with various functional groups on the antibody. Such derivatization requires the use of certain coupling agents, examples of which include, but are not limited to, maleic anhydride, N-hydroxysuccinimide, and 1-ethyl-3-(3-dimethylaminopropyl) carbodiimide. If desired, one or more capture reagents, such as antibodies (or fragments thereof), each of which is specific for analyte(s) can be attached to solid phases in different physical or addressable locations (e.g., such as in a biochip configuration (see, e.g., U.S. Pat. No. 6,225,047; PCT Publication No. WO 99/51773; U.S. Pat. No. 6,329,209; PCT Publication No. WO 00/56934; and U.S. Pat. No. 5,242,828). If the capture reagent is attached to a mass spectrometry probe as the solid support, the amount of analyte bound to the probe can be detected by laser desorption ionization mass spectrometry. Alternatively, a single column can be packed with different beads, which are derivatized with the one or more capture reagents, thereby capturing the analyte in a single place (see, antibody-derivatized, bead-based technologies, e.g., the xMAP technology of Luminex (Austin, Tex.)).

After the test sample being assayed for analyte (or a fragment thereof) is brought into contact with the at least one capture antibody (for example, the first capture antibody), the mixture is incubated in order to allow for the formation of a first antibody (or multiple antibody)-analyte (or a fragment thereof) complex. The incubation can be carried out at a pH of from about 4.5 to about 10.0, at a temperature of from about 2° C. to about 45° C., and for a period from at least about one (1) minute to about eighteen (18) hours, preferably from about 1 to about 24 minutes, most preferably for about 4 to about 18 minutes. The immunoassay described herein can be conducted in one step (meaning the test sample, at least one capture antibody and at least one detection antibody are all added sequentially or simultaneously to a reaction vessel) or in more than one step, such as two steps, three steps, etc.

After formation of the (first or multiple) capture antibody/analyte (or a fragment thereof) complex, the complex is then contacted with at least one detection antibody under conditions which allow for the formation of a (first or multiple) capture antibody/analyte (or a fragment thereof)/second detection antibody complex). While captioned for clarity as the "second" antibody (e.g., second detection antibody), in fact, where multiple antibodies are used for capture and/or detection, the at least one detection antibody can be the second, third, fourth, etc. antibodies used in the immunoassay. If the capture antibody/analyte (or a fragment thereof) complex is contacted with more than one detection antibody, then a (first or multiple) capture antibody/analyte (or a fragment thereof)/(multiple) detection antibody complex is formed. As with the capture antibody (e.g., the first capture antibody), when the at least one (e.g., second and any subsequent) detection antibody is brought into contact with the capture antibody/analyte (or a fragment thereof) complex, a period of incubation under conditions similar to those described above is required for the formation of the (first or multiple) capture antibody/analyte (or a fragment thereof)/(second or multiple) detection antibody complex. Preferably, at least one detection antibody contains a detectable label. The detectable label can be bound to the at least one detection antibody (e.g., the second detection antibody) prior to, simultaneously with, or after the formation of the (first or multiple) capture antibody/analyte (or a fragment thereof)/(second or multiple) detection antibody complex. Any detectable label known in the art can be used (see discussion above, including of the Polak and Van Noorden (1997) and Haugland (1996) references).

The detectable label can be bound to the antibodies either directly or through a coupling agent. An example of a coupling agent that can be used is EDAC (1-ethyl-3-(3-dimethylaminopropyl) carbodiimide, hydrochloride), which is commercially available from Sigma-Aldrich, St. Louis, Mo. Other coupling agents that can be used are known in the art. Methods for binding a detectable label to an antibody are known in the art. Additionally, many detectable labels can be purchased or synthesized that already contain end groups that facilitate the coupling of the detectable label to the antibody, such as CPSP-Acridinium Ester (i.e., 9-[N-tosyl-N-(3-carboxypropyl)]-10-(3-sulfopropyl)acridinium carboxamide) or SPSP-Acridinium Ester (i.e., N10-(3-sulfopropyl)-N-(3-sulfopropyl)-acridinium-9-carboxamide).

The (first or multiple) capture antibody/analyte/(second or multiple) detection antibody complex can be, but does not have to be, separated from the remainder of the test sample prior to quantification of the label. For example, if the at least one capture antibody (e.g., the first capture antibody) is bound to a solid support, such as a well or a bead, separation can be accomplished by removing the fluid (of the test sample) from contact with the solid support. Alternatively, if the at least first capture antibody is bound to a solid support, it can be simultaneously contacted with the analyte-containing sample and the at least one second detection antibody to form a first (multiple) antibody/analyte/second (multiple) antibody complex, followed by removal of the fluid (test sample) from contact with the solid support. If the at least one first capture antibody is not bound to a solid support, then the (first or multiple) capture antibody/analyte/(second or multiple) detection antibody complex does not have to be removed from the test sample for quantification of the amount of the label.

After formation of the labeled capture antibody/analyte/detection antibody complex (e.g., the first capture antibody/analyte/second detection antibody complex), the amount of label in the complex is quantified using techniques known in the art. For example, if an enzymatic label is used, the labeled complex is reacted with a substrate for the label that gives a quantifiable reaction such as the development of color. If the label is a radioactive label, the label is quantified using appropriate means, such as a scintillation counter. If the label is a fluorescent label, the label is quantified by stimulating the label with a light of one color (which is known as the "excitation wavelength") and detecting another color (which is known as the "emission wavelength") that is emitted by the label in response to the stimulation. If the label is a chemiluminescent label, the label is quantified by detecting the light emitted either visually or by using luminometers, x-ray film, high speed photographic film, a CCD camera, etc. Once the amount of the label in the complex has been quantified, the concentration of analyte or a fragment thereof in the test sample is determined by appropriate means, such as by use of a standard curve that has been generated using serial dilutions of analyte or a fragment thereof of known concentration. Other than using serial dilutions of analyte or a fragment thereof, the standard curve can be generated gravimetrically, by mass spectroscopy and by other techniques known in the art.

In a chemiluminescent microparticle assay employing the ARCHITECT® analyzer, the conjugate diluent pH should be about 6.0+/−0.2, the microparticle coating buffer should be maintained at about room temperature (i.e., at from about 17 to about 27° C.), the microparticle coating buffer pH should be about 6.5+/−0.2, and the microparticle diluent pH should be about 7.8+/−0.2. Solids preferably are less than about 0.2%, such as less than about 0.15%, less than about 0.14%, less than about 0.13%, less than about 0.12%, or less than about 0.11%, such as about 0.10%.

FPIAs are based on competitive binding immunoassay principles. A fluorescently labeled compound, when excited by a linearly polarized light, will emit fluorescence having a degree of polarization inversely proportional to its rate of rotation. When a fluorescently labeled tracer-antibody complex is excited by a linearly polarized light, the emitted light remains highly polarized because the fluorophore is constrained from rotating between the time light is absorbed and the time light is emitted. When a "free" tracer compound (i.e., a compound that is not bound to an antibody) is excited by linearly polarized light, its rotation is much faster than the corresponding tracer-antibody conjugate produced in a competitive binding immunoassay. FPIAs are advantageous over RIAs inasmuch as there are no radioactive substances requiring special handling and disposal. In addition, FPIAs are homogeneous assays that can be easily and rapidly performed.

In view of the above, a method of determining the presence, amount, or concentration of analyte (or a fragment thereof) in a test sample is provided. The method comprises assaying the test sample for an analyte (or a fragment thereof) by an assay (i) employing (i') at least one of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) that can bind to an analyte, and (ii') at least one detectable label and (ii) comprising comparing a signal generated by the detectable label as a direct or indirect indication of the presence, amount or concentration of analyte (or a fragment thereof) in the test sample to a signal generated as a direct or indirect indication of the presence, amount or concentration of analyte (or a fragment thereof) in a control or calibrator. The calibrator is optionally part of a series of calibrators, in which each of the calibrators differs from the other calibrators by the concentration of analyte.

The method can comprise (i) contacting the test sample with at least one first specific binding partner for analyte (or a fragment thereof) selected from the group consisting of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) that can bind to an analyte so as to form a first specific binding partner/analyte (or fragment thereof) complex, (ii) contacting the first specific binding partner/analyte (or fragment thereof) complex with at least one second specific binding partner for analyte (or fragment thereof) selected from the group consisting of a detectably labeled anti-analyte antibody, a detectably labeled fragment of an anti-analyte antibody that can bind to analyte, a detectably labeled variant of an anti-analyte antibody that can bind to analyte, a detectably labeled fragment of a variant of an anti-analyte antibody that can bind to analyte, and a detectably labeled DVD-Ig (or a fragment, a variant, or a fragment of a variant thereof) so as to form a first specific binding partner/analyte (or fragment thereof)/second specific binding partner complex, and (iii) determining the presence, amount or concentration of analyte in the test sample by detecting or measuring the signal generated by the detectable label in the first specific binding partner/analyte (or fragment thereof)/second specific binding partner complex formed in (ii). A method in which at least one first specific binding partner for analyte (or a fragment thereof) and/or at least one second specific binding partner for analyte (or a fragment thereof) is a DVD-Ig (or a fragment, a variant, or a fragment of a variant thereof) as described herein can be preferred.

Alternatively, the method can comprise contacting the test sample with at least one first specific binding partner for an IL-17 analyte (or a fragment thereof) selected from the group consisting of an antibody, a fragment of an antibody that can bind to an analyte, a variant of an antibody that can bind to an analyte, a fragment of a variant of an antibody that can bind to an analyte, and a DVD-Ig (or a fragment, a variant, or a fragment of a variant thereof) and simultaneously or sequentially, in either order, contacting the test sample with at least one second specific binding partner, which can compete with analyte (or a fragment thereof) for binding to the at least one first specific binding partner and which is selected from the group consisting of a detectably labeled analyte, a detectably labeled fragment of analyte that can bind to the first specific binding partner, a detectably labeled variant of analyte that can bind to the first specific binding partner, and a detectably labeled fragment of a variant of analyte that can bind to the first specific binding partner. Any IL-17 (or a fragment thereof) present in the test sample and the at least one second specific binding partner compete with each other to form a first specific binding partner/analyte (or fragment thereof) complex and a first specific binding partner/second specific binding partner complex, respectively. The method further comprises determining the presence, amount or concentration of analyte in the test sample by detecting or measuring the signal generated by the detectable label in the first specific binding partner/second specific binding partner complex formed in (ii), wherein the signal generated by the detectable label in the first specific binding partner/second specific binding partner complex is inversely proportional to the amount or concentration of analyte in the test sample.

The above methods can further comprise diagnosing, prognosticating, or assessing the efficacy of a therapeutic/prophylactic treatment of a patient from whom the test sample was obtained. If the method further comprises assessing the efficacy of a therapeutic/prophylactic treatment of the patient from whom the test sample was obtained, the method optionally further comprises modifying the therapeutic/prophylactic treatment of the patient as needed to improve efficacy. The method can be adapted for use in an automated system or a semi-automated system.

With regard to the methods of assay (and kit therefor), it may be possible to employ commercially available anti-analyte antibodies or methods for production of anti-analyte as described in the literature. Commercial supplies of various antibodies include, but are not limited to, Santa Cruz Biotechnology Inc. (Santa Cruz, Calif.), GenWay Biotech, Inc. (San Diego, Calif.), and R&D Systems (RDS; Minneapolis, Minn.).

Generally, a predetermined level can be employed as a benchmark against which to assess results obtained upon assaying a test sample for analyte or a fragment thereof, e.g., for detecting disease or risk of disease. Generally, in making such a comparison, the predetermined level is obtained by running a particular assay a sufficient number of times and under appropriate conditions such that a linkage or association of analyte presence, amount or concentration with a particular stage or endpoint of a disease, disorder or condition or with particular clinical indicia can be made. Typically, the predetermined level is obtained with assays of reference subjects (or populations of subjects). The analyte measured can include fragments thereof, degradation products thereof, and/or enzymatic cleavage products thereof.

In particular, with respect to a predetermined level as employed for monitoring disease progression and/or treatment, the amount or concentration of analyte or a fragment thereof may be "unchanged," "favorable" (or "favorably altered"), or "unfavorable" (or "unfavorably altered"). "Elevated" or "increased" refers to an amount or a concentration in a test sample that is higher than a typical or normal level or range (e.g., predetermined level), or is higher than another reference level or range (e.g., earlier or baseline sample). The term "lowered" or "reduced" refers to an amount or a concentration in a test sample that is lower than a typical or normal level or range (e.g., predetermined level), or is lower than another reference level or range (e.g., earlier or baseline sample). The term "altered" refers to an amount or a concentration in a sample that is altered (increased or decreased) over a typical or normal level or range (e.g., predetermined level), or over another reference level or range (e.g., earlier or baseline sample).

The typical or normal level or range for analyte is defined in accordance with standard practice. Because the levels of analyte in some instances will be very low, a so-called altered level or alteration can be considered to have occurred when there is any net change as compared to the typical or normal level or range, or reference level or range, that cannot be explained by experimental error or sample variation. Thus, the level measured in a particular sample will be compared with the level or range of levels determined in similar samples from a so-called normal subject. In this context, a "normal subject" is an individual with no detectable disease, for example, and a "normal" (sometimes termed "control") patient or population is/are one(s) that exhibit(s) no detectable disease, respectively, for example. Furthermore, given that analyte is not routinely found at a high level in the majority of the human population, a "normal subject" can be considered an individual with no substantial detectable increased or elevated amount or concentration of analyte, and a "normal" (sometimes termed "control") patient or population is/are one(s) that exhibit(s) no substantial detectable increased or elevated amount or concentration of analyte. An "apparently normal subject" is one in which analyte has not yet been or currently is being assessed. The level of an analyte is said to be "elevated" when the analyte is normally undetectable (e.g., the normal level is zero, or within a range of from about 25 to about 75 percentiles of normal populations), but is detected in a test sample, as well as when the analyte is present in the test sample at a higher than normal level. Thus, inter alia, the disclosure provides a method of screening for a subject having, or at risk of having, a particular disease, disorder, or condition. The method of assay can also involve the assay of other markers and the like.

Accordingly, the methods described herein also can be used to determine whether or not a subject has or is at risk of developing a given disease, disorder or condition. Specifically, such a method can comprise the steps of:

(a) determining the concentration or amount in a test sample from a subject of IL-17 (or a fragment thereof) (e.g., using the methods described herein, or methods known in the art); and (b) comparing the concentration or amount of IL-17 (or a fragment thereof) determined in step (a) with a predetermined level, wherein, if the concentration or amount of analyte determined in step (a) is favorable with respect to a predetermined level, then the subject is determined not to have or be at risk for a given disease, disorder or condition. However, if the concentration or amount of IL-17 determined in step (a) is unfavorable with respect to the predetermined level, then the subject is determined to have or be at risk for a given disease, disorder or condition.

Additionally, provided herein is method of monitoring the progression of disease in a subject. Optimally the method comprising the steps of:

(a) determining the concentration or amount in a test sample from a subject of IL-17;

(b) determining the concentration or amount in a later test sample from the subject of IL-17; and (c) comparing the concentration or amount of analyte as determined in step (b) with the concentration or amount of IL-17 determined in step (a), wherein if the concentration or amount determined in step (b) is unchanged or is unfavorable when compared to the concentration or amount of IL-17 determined in step (a), then the disease in the subject is determined to have continued, progressed or worsened. By comparison, if the concentration or amount of IL-17 as determined in step (b) is favorable when compared to the concentration or amount of IL-17 as determined in step (a), then the disease in the subject is determined to have discontinued, regressed or improved.

Optionally, the method further comprises comparing the concentration or amount of IL-17 analyte as determined in step (b), for example, with a predetermined level. Further, optionally the method comprises treating the subject with one or more pharmaceutical compositions for a period of time if the comparison shows that the concentration or amount of analyte as determined in step (b), for example, is unfavorably altered with respect to the predetermined level.

Still further, the methods can be used to monitor treatment in a subject receiving treatment with one or more pharmaceutical compositions. Specifically, such methods involve providing a first test sample from a subject before the subject has been administered one or more pharmaceutical compositions. Next, the concentration or amount in a first test sample from a subject of IL-17 is determined (e.g., using the methods described herein or as known in the art). After the concentration or amount of IL-17 is determined, optionally the concentration or amount of IL-17 is then compared with a predetermined level. If the concentration or amount of IL-17 as determined in the first test sample is lower than the predetermined level, then the subject is not treated with one or more pharmaceutical compositions. However, if the concentration or amount of IL-17 as determined in the first test sample is higher than the predetermined level, then the subject is treated with one or more pharmaceutical compositions for a period of time. The period of time that the subject is treated with the one or more pharmaceutical compositions can be determined by one skilled in the art (for example, the period of time can be from about seven (7) days to about two years, preferably from about fourteen (14) days to about one (1) year).

During the course of treatment with the one or more pharmaceutical compositions, second and subsequent test samples are then obtained from the subject. The number of test samples and the time in which said test samples are obtained from the subject are not critical. For example, a second test sample could be obtained seven (7) days after the subject is first administered the one or more pharmaceutical compositions, a third test sample could be obtained two (2) weeks after the subject is first administered the one or more pharmaceutical compositions, a fourth test sample could be obtained three (3) weeks after the subject is first administered the one or more pharmaceutical compositions, a fifth test sample could be obtained four (4) weeks after the subject is first administered the one or more pharmaceutical compositions, etc.

After each second or subsequent test sample is obtained from the subject, the concentration or amount of IL-17 analyte is determined in the second or subsequent test sample is determined (e.g., using the methods described herein or as known in the art). The concentration or amount of IL-17 as determined in each of the second and subsequent test samples is then compared with the concentration or amount of analyte as determined in the first test sample (e.g., the test sample that was originally optionally compared to the predetermined level). If the concentration or amount of IL-17 as determined in step (c) is favorable when compared to the concentration or amount of analyte as determined in step (a), then the disease in the subject is determined to have discontinued, regressed or improved, and the subject should continue to be administered the one or pharmaceutical compositions of step (b). However, if the concentration or amount determined in step (c) is unchanged or is unfavorable when compared to the concentration or amount of analyte as determined in step (a), then the disease in the subject is determined to have continued, progressed or worsened, and the subject should be treated with a higher concentration of the one or more pharmaceutical compositions administered to the subject in step (b) or the subject should be treated with one or more pharmaceutical compositions that are different from the one or more pharmaceutical compositions administered to the subject in step (b). Specifically, the subject can be treated with one or more pharmaceutical compositions that are different from the one or more pharmaceutical compositions that the subject had previously received to decrease or lower said subject's analyte level.

Generally, for assays in which repeat testing may be done (e.g., monitoring disease progression and/or response to treatment), a second or subsequent test sample is obtained at a period in time after the first test sample has been obtained from the subject. Specifically, a second test sample from the subject can be obtained minutes, hours, days, weeks or years after the first test sample has been obtained from the subject. For example, the second test sample can be obtained from the subject at a time period of about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years after the first test sample from the subject is obtained.

When used to monitor disease progression, the above assay can be used to monitor the progression of disease in subjects suffering from acute conditions. Acute conditions, also known as critical care conditions, refer to acute, life-threatening diseases or other critical medical conditions involving, for example, the cardiovascular system or excretory system. Typically, critical care conditions refer to those conditions requiring acute medical intervention in a hospital-based setting (including, but not limited to, the emergency room, intensive care unit, trauma center, or other emergent care setting) or administration by a paramedic or other field-based medical personnel. For critical care conditions, repeat monitoring is generally done within a shorter time frame, namely, minutes, hours or days (e.g., about 1 minute, about 5 minutes, about 10 minutes, about 15 minutes, about 30 minutes, about 45 minutes, about 60 minutes, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days or about 7 days), and the initial assay likewise is generally done within a shorter timeframe, e.g., about minutes, hours or days of the onset of the disease or condition.

The assays also can be used to monitor the progression of disease in subjects suffering from chronic or non-acute conditions. Non-critical care or, non-acute conditions, refers to conditions other than acute, life-threatening disease or other critical medical conditions involving, for example, the cardiovascular system and/or excretory system. Typically, non-acute conditions include those of longer-term or chronic duration. For non-acute conditions, repeat monitoring generally is done with a longer timeframe, e.g., hours, days, weeks, months or years (e.g., about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 24 hours, about 2 days, about 3 days, about 4 days, about 5 days, about 6 days, about 7 days, about 2 weeks, about 3 weeks, about 4 weeks, about 5 weeks, about 6 weeks, about 7 weeks, about 8 weeks, about 9 weeks, about 10 weeks, about 11 weeks, about 12 weeks, about 13 weeks, about 14 weeks, about 15 weeks, about 16 weeks, about 17 weeks, about 18 weeks, about 19 weeks, about 20 weeks, about 21 weeks, about 22 weeks, about 23 weeks, about 24 weeks, about 25 weeks, about 26 weeks, about 27 weeks, about 28 weeks, about 29 weeks, about 30 weeks, about 31 weeks, about 32 weeks, about 33 weeks, about 34 weeks, about 35 weeks, about 36 weeks, about 37 weeks, about 38 weeks, about 39 weeks, about 40 weeks, about 41 weeks, about 42 weeks, about 43 weeks, about 44 weeks, about 45 weeks, about 46 weeks, about 47 weeks, about 48 weeks, about 49 weeks, about 50 weeks, about 51 weeks, about 52 weeks, about 1.5 years, about 2 years, about 2.5 years, about 3.0 years, about 3.5 years, about 4.0 years, about 4.5 years, about 5.0 years, about 5.5. years, about 6.0 years, about 6.5 years, about 7.0 years, about 7.5 years, about 8.0 years, about 8.5 years, about 9.0 years, about 9.5 years or about 10.0 years), and the initial assay likewise generally is done within a longer time frame, e.g., about hours, days, months or years of the onset of the disease or condition.

Furthermore, the above assays can be performed using a first test sample obtained from a subject where the first test sample is obtained from one source, such as urine, serum or plasma. Optionally, the above assays can then be repeated using a second test sample obtained from the subject where the second test sample is obtained from another source. For example, if the first test sample was obtained from urine, the second test sample can be obtained from serum or plasma. The results obtained from the assays using the first test sample and the second test sample can be compared. The comparison can be used to assess the status of a disease or condition in the subject.

Moreover, the present disclosure also relates to methods of determining whether a subject predisposed to or suffering from a given disease, disorder or condition will benefit from treatment. In particular, the disclosure relates to analyte companion diagnostic methods and products. Thus, the method of "monitoring the treatment of disease in a subject" as described herein further optimally also can encompass selecting or identifying candidates for therapy.

Thus, in particular embodiments, the disclosure also provides a method of determining whether a subject having, or at risk for, a given disease, disorder or condition is a candidate for therapy. Generally, the subject is one who has experienced some symptom of a given disease, disorder or condition or who has actually been diagnosed as having, or being at risk for, a given disease, disorder or condition, and/or who demonstrates an unfavorable concentration or amount of analyte or a fragment thereof, as described herein.

The method optionally comprises an assay as described herein, where IL-17 is assessed before and following treatment of a subject with one or more pharmaceutical compositions (e.g., particularly with a pharmaceutical related to a mechanism of action involving analyte), with immunosuppressive therapy, or by immunoabsorption therapy, or where analyte is assessed following such treatment and the concentration or the amount of analyte is compared against a predetermined level. An unfavorable concentration of amount of IL-17 observed following treatment confirms that the subject will not benefit from receiving further or continued treatment, whereas a favorable concentration or amount of analyte observed following treatment confirms that the subject will benefit from receiving further or continued treatment. This confirmation assists with management of clinical studies, and provision of improved patient care.

It goes without saying that, while certain embodiments herein are advantageous when employed to assess a given disease, disorder or condition as discussed herein, the assays and kits can be employed to assess analyte in other diseases, disorders and conditions. The method of assay can also involve the assay of other markers and the like.

The method of assay also can be used to identify a compound that ameliorates a given disease, disorder or condition. For example, a cell that expresses analyte can be contacted with a candidate compound. The level of expression of analyte in the cell contacted with the compound can be compared to that in a control cell using the method of assay described herein.

II. Kits

A kit for assaying a test sample for the presence, amount or concentration of an analyte (or a fragment thereof) in a test sample is also provided. The kit comprises at least one component for assaying the test sample for IL-17 (or a fragment thereof) and instructions for assaying the test sample for the analyte (or a fragment thereof). The at least one component for assaying the test sample for the analyte (or a fragment thereof) can include a composition comprising an anti-IL-17 binding protein, such as a monoclonal antibody or DVD-Ig (or a fragment, a variant, or a fragment of a variant thereof), as described herein and which is optionally immobilized on a solid phase.

The kit can comprise at least one component for assaying the test sample for an IL-17 analyte by immunoassay, e.g., chemiluminescent microparticle immunoassay, and instructions for assaying the test sample for an IL-17 analyte by immunoassay, e.g., chemiluminescent microparticle immunoassay. For example, the kit can comprise at least one specific binding partner for IL-17, such as an anti-IL-17 monoclonal/polyclonal antibody (or a fragment thereof that can bind to the IL-17 analyte, a variant thereof that can bind to the analyte, or a fragment of a variant that can bind to the analyte) or an anti-IL-17 DVD-Ig (or a fragment, a variant, or a fragment of a variant thereof), either of which can be detectably labeled. Alternatively or additionally, the kit can comprise detectably labeled IL-17 analyte (or a fragment thereof that can bind to an anti-analyte, monoclonal/polyclonal antibody or an anti-analyte DVD-Ig (or a fragment, a variant, or a fragment of a variant thereof)), which can compete with any analyte in a test sample for binding to an anti-analyte monoclonal/polyclonal antibody (or a fragment thereof that can bind to the analyte, a variant thereof that can bind to the analyte, or a fragment of a variant that can bind to the analyte) or an anti-analyte DVD-Ig (or a fragment, a variant, or a fragment of a variant thereof), either of which can be immobilized on a solid support. The kit can comprise a calibrator or control, e.g., isolated or purified analyte. The kit can comprise at least one container (e.g., tube, microtiter plates or strips, which can be already coated with a first specific binding partner, for example) for conducting the assay, and/or a buffer, such as an assay buffer or a wash buffer, either one of which can be provided as a concentrated solution, a substrate solution for the detectable label (e.g., an enzymatic label), or a stop solution. Preferably, the kit comprises all components, i.e., reagents, standards, buffers, diluents, etc., which are necessary to perform the assay. The instructions can be in paper form or computer-readable form, such as a disk, CD, DVD, or the like.

Any binding protein, such as an anti-IL-17 binding protein or an anti-analyte DVD-Ig, or tracer can incorporate a detectable label as described herein, such as a fluorophore, a radioactive moiety, an enzyme, a biotin/avidin label, a chromophore, a chemiluminescent label, or the like, or the kit can include reagents for carrying out detectable labeling. The antibodies, calibrators and/or controls can be provided in separate containers or pre-dispensed into an appropriate assay format, for example, into microtiter plates.

Optionally, the kit includes quality control components (for example, sensitivity panels, calibrators, and positive controls). Preparation of quality control reagents is well-known in the art and is described on insert sheets for a variety of immunodiagnostic products. Sensitivity panel members optionally are used to establish assay performance characteristics, and further optionally are useful indicators of the integrity of the immunoassay kit reagents, and the standardization of assays.

The kit can also optionally include other reagents required to conduct a diagnostic assay or facilitate quality control evaluations, such as buffers, salts, enzymes, enzyme co-factors, enzyme substrates, detection reagents, and the like. Other components, such as buffers and solutions for the isolation and/or treatment of a test sample (e.g., pretreatment reagents), also can be included in the kit. The kit can additionally include one or more other controls. One or more of the components of the kit can be lyophilized, in which case the kit can further comprise reagents suitable for the reconstitution of the lyophilized components.

The various components of the kit optionally are provided in suitable containers as necessary, e.g., a microtiter plate. The kit can further include containers for holding or storing a sample (e.g., a container or cartridge for a urine sample). Where appropriate, the kit optionally also can contain reaction vessels, mixing vessels, and other components that facilitate the preparation of reagents or the test sample. The kit can also include one or more instruments for assisting with obtaining a test sample, such as a syringe, pipette, forceps, measured spoon, or the like.

If the detectable label is at least one acridinium compound, the kit can comprise at least one acridinium-9-carboxamide, at least one acridinium-9-carboxylate aryl ester, or any combination thereof. If the detectable label is at least one acridinium compound, the kit also can comprise a source of hydrogen peroxide, such as a buffer, a solution, and/or at least one basic solution. If desired, the kit can contain a solid phase, such as a magnetic particle, bead, test tube, microtiter plate, cuvette, membrane, scaffolding molecule, film, filter paper, disc or chip.

III. Adaptation of Kit and Method

The kit (or components thereof), as well as the method of determining the presence, amount or concentration of an analyte in a test sample by an assay, such as an immunoassay as described herein, can be adapted for use in a variety of automated and semi-automated systems (including those wherein the solid phase comprises a microparticle), as described, e.g., in U.S. Pat. Nos. 5,089,424 and 5,006,309, and as commercially marketed, e.g., by Abbott Laboratories (Abbott Park, Ill.) as ARCHITECT®.

Some of the differences between an automated or semi-automated system as compared to a non-automated system (e.g., ELISA) include the substrate to which the first specific binding partner (e.g., an anti-analyte, monoclonal/polyclonal antibody (or a fragment thereof, a variant thereof, or a fragment of a variant thereof) or an anti-analyte DVD-Ig (or a fragment thereof, a variant thereof, or a fragment of a variant thereof) is attached; either way, sandwich formation and analyte reactivity can be impacted), and the length and timing of the capture, detection and/or any optional wash steps. Whereas a non-automated format, such as an ELISA, may require a relatively longer incubation time with sample and capture reagent (e.g., about 2 hours), an automated or semi-automated format (e.g., ARCHITECT®, Abbott Laboratories) may have a relatively shorter incubation time (e.g., approximately 18 minutes for ARCHITECT®). Similarly, whereas a non-automated format, such as an ELISA, may incubate a detection antibody, such as the conjugate reagent, for a relatively longer incubation time (e.g., about 2 hours), an automated or semi-automated format (e.g., ARCHITECT®) may have a relatively shorter incubation time (e.g., approximately 4 minutes for the ARCHITECT®).

Other platforms available from Abbott Laboratories include, but are not limited to, AxSYM®, IMx® (see, e.g., U.S. Pat. No. 5,294,404), PRISM®, EIA (bead), and Quantum™ II, as well as other platforms. Additionally, the assays, kits and kit components can be employed in other formats, for example, on electrochemical or other hand-held or point-of-care assay systems. The present disclosure is, for example, applicable to the commercial Abbott Point of Care (i-STAT®, Abbott Laboratories) electrochemical immunoassay system that performs sandwich Immunoassays. Immunosensors and their methods of manufacture and operation in single-use test devices are described, for example in, U.S. Pat. No. 5,063,081, US Patent Application Publication No. 2003/0170881, US Patent Application Publication No. 2004/0018577, US Patent Application Publication No. 2005/0054078, and US Patent Application Publication No. 2006/0160164.

In particular, with regard to the adaptation of an analyte assay to the I-STAT® system, the following configuration is preferred. A microfabricated silicon chip is manufactured with a pair of gold amperometric working electrodes and a silver-silver chloride reference electrode. On one of the working electrodes, polystyrene beads (0.2 mm diameter) with immobilized anti-analyte, monoclonal/polyclonal antibody (or a fragment thereof, a variant thereof, or a fragment of a variant thereof) or anti-analyte DVD-Ig (or a fragment thereof, a variant thereof, or a fragment of a variant thereof), are adhered to a polymer coating of patterned polyvinyl alcohol over the electrode. This chip is assembled into an I-STAT® cartridge with a fluidics format suitable for immunoassay. On a portion of the wall of the sample-holding chamber of the cartridge there is a layer comprising a specific binding partner for an analyte, such as an anti-analyte, monoclonal/polyclonal antibody (or a fragment thereof, a variant thereof, or a fragment of a variant thereof that can bind the analyte) or an anti-analyte DVD-Ig (or a fragment thereof, a variant thereof, or a fragment of a variant thereof that can bind the analyte), either of which can be detectably labeled. Within the fluid pouch of the cartridge is an aqueous reagent that includes p-aminophenol phosphate.

In operation, a sample suspected of containing an analyte is added to the holding chamber of the test cartridge, and the cartridge is inserted into the I-STAT® reader. After the specific binding partner for an analyte has dissolved into the sample, a pump element within the cartridge forces the sample into a conduit containing the chip. Here it is oscillated to promote formation of the sandwich. In the penultimate step of the assay, fluid is forced out of the pouch and into the conduit to wash the sample off the chip and into a waste chamber. In the final step of the assay, the alkaline phosphatase label reacts with p-aminophenol phosphate to cleave the phosphate group and permit the liberated p-aminophenol to be electrochemically oxidized at the working electrode. Based on the measured current, the reader is able to calculate the amount of analyte in the sample by means of an embedded algorithm and factory-determined calibration curve.

It further goes without saying that the methods and kits as described herein necessarily encompass other reagents and methods for carrying out the immunoassay. For instance, encompassed are various buffers such as are known in the art and/or which can be readily prepared or optimized to be employed, e.g., for washing, as a conjugate diluent, microparticle diluent, and/or as a calibrator diluent. An exemplary conjugate diluent is ARCHITECT® conjugate diluent employed in certain kits (Abbott Laboratories, Abbott Park, Ill.) and containing 2-(N-morpholino)ethanesulfonic acid (MES), a salt, a protein blocker, an antimicrobial agent, and a detergent. An exemplary calibrator diluent is ARCHITECT® human calibrator diluent employed in certain kits (Abbott Laboratories, Abbott Park, Ill.), which comprises a buffer containing MES, other salt, a protein blocker, and an antimicrobial agent. Additionally, as described in U.S. patent application Ser. No. 12/650,241 (see, also PCT/US2009/069846), improved signal generation may be obtained, e.g., in an I-Stat cartridge format, using a nucleic acid sequence linked to the signal antibody as a signal amplifier.

It will be readily apparent to those skilled in the art that other suitable modifications and adaptations of the methods of the invention described herein are obvious and may be made using suitable equivalents without departing from the scope of the invention or the embodiments disclosed herein.

Having now described the present invention in detail, the same will be more clearly understood by reference to the following examples, which are included for purposes of illustration only and are not intended to be limiting of the invention.

EXAMPLES

Example 1

Murine, Chimeric, and Humanized Anti-Human IL-17 Antibodies 1.1: Construction and Expression of Murine Monoclonal and Recombinant Chimeric Anti Human IL-17 Antibodies Murine monoclonal antibodies to human IL-17 (hIL-17) were obtained by standard methods. Balb/c and A/J mice, 4-6 weeks of age, were immunized and boosted subcutaneously with recombinant human IL-17 Animals were injected every three weeks, beginning with a primary injection of 15 µg in complete Freund's adjuvant and injection boosts of 15 µg in Incomplete Freund's Adjuvant. Mice selected for fusion were injected intravenously with IL-17 in saline, four days prior to fusion. Spleens from immunized animals were removed and single cell suspensions were prepared. SP2/0 myeloma cells were harvested from culture and washed. Spleen cells and tumor cells were mixed at a ratio of 5:1 and fused using 50% PEG 3000 using standard techniques (Kohler and Milstein, *Nature*, 256: 495-497 (1975)). Fused cells were seeded in 96 well plates in selective media, at a density of $2.5 \times 10^5$ spleen cells per well. Fusions were incubated at 37° C. for 7-10 days. When macroscopic colonies were observed, supernatants were removed and tested by ELISA. Cells that show binding to human and cyno IL-17 proteins were subcloned and antibody proteins purified. Murine anti hIL-17 monoclonal antibodies 10F7, 5C5, 6C6, 7D7, 1D8, 8B12, and 10G9 were isolated and the amino acid sequences of the variable heavy (VH) and variable light (VL) chains determined. See, Table 5.

The DNA encoding the heavy chain constant region of murine anti-human IL-17 monoclonal antibodies 10F7, 5C5, 6C6, 7D7, 1D8, 8B12, and 10G9 was replaced by a cDNA fragment encoding the human IgG1 constant region containing 2 hinge-region amino acid mutations by homologous recombination in bacteria. These mutations were a leucine to alanine change at position 234 (EU numbering) and a leucine to alanine change at position 235 (Lund et al., *J. Immunol.*, 147: 2657 (1991)). The light chain constant region of each of these antibodies was replaced by a human kappa constant region. Full-length chimeric antibodies were transiently expressed in HEK293 cells by co-transfection of chimeric heavy and light chain cDNAs ligated into the pHybE expression plasmid. Cell supernatants containing recombinant chimeric antibody were purified by Protein A Sepharose chromatography and bound antibody was eluted by addition of acid buffer. Antibodies were neutralized and dialyzed into PBS.

The purified chimeric anti-human IL-17 monoclonal antibodies were then tested for their ability to bind the hIL-17 protein by ELISA to confirm antigen binding. See, Example 1.5.1, below.

1.2: Construction of CDR Grafted and Humanized Anti Human IL-17 Antibodies

By applying standard methods well known in the art, the CDR sequences of VH and VL chains of monoclonal antibody 10F7 and 5C5 (see Table 5, above) were grafted into different human heavy and light chain acceptor sequences.

Based on sequence VH and VL alignments with the VH and VL sequences of monoclonal antibody 10F7 of the present invention the following known human sequences are selected:

a) VH1-69 (IGHV1-69) and the joining sequences hJH6 for constructing heavy chain acceptor sequences b) 1-17/A30 and 6-21/A26 as well as hJK2 and hJK4 for constructing light chain acceptor sequences By grafting the corresponding VH and VL CDRs of 10F7 into said acceptor sequences, the CDR-grafted, humanized, and modified VH and VL sequences were prepared.

Based on sequence VH and VL alignments with the VH and VL sequences of monoclonal antibody 5C5 of the present invention the following known human sequences are selected:

c) VH1-69 (IGHV1-69) and the joining sequences hJH1, hJH3, hJH4, hJH5, and hJH6 for constructing heavy chain acceptor sequences d) 1-33/O18 and 3-15/L2 as well as hJK2 and hJK4 for constructing light chain acceptor sequences By grafting the corresponding VH and VL CDRs of 5C5 into said acceptor sequences, the CDR-grafted, humanized, and modified VH and VL sequences were prepared (see, Table 7, above).

1.3: Construction of Framework Back Mutations in CDR-Grafted Antibodies

To generate humanized antibody framework back mutations, mutations were introduced into the CDR-grafted antibody sequences by de novo synthesis of the variable domain and/or using mutagenic primers and PCR, and methods well known in the art. Different combinations of back mutations and other mutations are constructed for each of the CDR-grafts as follows. Residue numbers for these mutations are based on the Kabat numbering system.

For heavy chains h10F7VH.1z, one or more of the following Vernier and VH/VL interfacing residues were back mutated as follows: M48→I, V67→A, I69→L, and A93→T.

Additional mutations include the following: Q1→E, G27→Y, and S30→T.

For light chain h10F7Vk.1z and 3z one or more of the following Vernier and VH/VL interfacing residues were back mutated as follows: D1→Q, Q3→V, M4→L, Y36→F, A43→S, L47→W, and F71→Y.

Additional mutation include the following: E70→D, D1→E

For light chain h10F7Vk.2 and 4 one or more of the following Vernier and VH/VL interfacing residues were back mutated as follows: E1→Q, Y36→F, L46→R, L47→W, K49→Y, and F71→Y For heavy chains h5C5VH.1z, one or more of the following Vernier and VH/VL interfacing residues were back mutated as follows: M48→I, V67→A, I69→L, A93→T Additional mutations include the following: Q1→E, S16→A, G27→Y, and S30→T For light chain h5C5Vk.1z and 2z one or more of the following Vernier and VH/VL interfacing residues were back mutated as follows: D1→N, Q3→V, Y36→F, A43→S, and Y87→F.

Additional mutation include the following: S7→T, I83→F

For light chain h5C5Vk.3z and 4z one or more of the following Vernier and VH/VL interfacing residues were back mutated as follows: E1→N, Y36→F, A43→S, I58→V, Y87→F.

Additional mutation include the following: S7→T, E70→D, and S80→P 1.4: Generation of Humanized Anti-hIL-17 Antibodies Containing Framework Back Mutations in CDR-Grafted Antibodies The following humanized variable regions of the murine monoclonal antibody 10F7 were cloned into IgG expression vectors for functional characterization.

TABLE 9

Sequences of humanized variable regions.

| SEQ ID NO: | Protein region | Sequence 123456789012345678901234567890 |
|---|---|---|
| 60 | h10F7VH.1 | EVQLVQSGAEVKKPGSSVKVSCKASGYTFTD YEIHWVRQAPGQGLEWMGVNDPESGGTFYNQ KFDGRVTITADKSTSTAYMELSSLRSEDTAV YYCARYYRYESFYGMDYWGQGTTVTVSS |
| 61 | h10F7VH.1a | EVQLVQSGAEVKKPGSSVKVSCKASGYTFTD YEIHWVRQAPGQGLEWIGVNDPESGGTFYNQ KFDGRATLTADKSTSTAYMELSSLRSEDTAV YYCTRYYRYESFYGMDYWGQGTTVTVSS |
| 62 | h10F7Vk.1 | DIQMTQSPSSLSASVGDRVTITCSASSSISY IYWYQQKPGKAPKRLIYATFELASGVPSRFS GSGSGTDFTLTISSLQPEDFATYYCHQRSSY PWTFGQGTKLEIKR |
| 63 | h10F7Vk.1a | DIQLTQSPSSLSASVGDRVTITCSASSSISY IYWFQQKPGKSPKRWIYATFELASGVPSRFS GSGSGTDYTLTISSLQPEDFATYYCHQRSSY PWTFGQGTKLEIKR |
| 64 | h10F7Vk.1b | QIVLTQSPSSLSASVGDRVTITCSASSSISY IYWFQQKPGKSPKRWIYATFELASGVPSRFS GSGSGTDYTLTISSLQPEDFATYYCHQRSSY PWTFGQGTKLEIKR |
| 65 | h10F7Vk.1c | EIVLTQSPSSLSASVGDRVTITCSASSSISY IYWFQQKPGKSPKRWIYATFELASGVPSRFS GSGSGTDYTLTISSLQPEDFATYYCHQRSSY PWTFGQGTKLEIKR |
| 66 | h10F7Vk.2 | EIVLTQSPDFQSVTPKEKVTITCSASSSISY IYWYQQKPDQSPKLLIKATFELASGVPSRFS GSGSGTDFTLTINSLEAEDAATYYCHQRSSY PWTFGQGTKLEIKR |
| 67 | h10F7Vk.2a | EIVLTQSPDFQSVTPKEKVTITCSASSSISY IYWFQQKPDQSPKRWIYATFELASGVPSRFS GSGSGTDYTLTINSLEAEDAATYYCHQRSSY PWTFGQGTKLEIKR |
| 68 | h10F7Vk.2b | QIVLTQSPDFQSVTPKEKVTITCSASSSISY IYWFQQKPDQSPKRWIYATFELASGVPSRFS GSGSGTDYTLTINSLEAEDAATYYCHQRSSY PWTFGQGTKLEIKR |

The different combinations of humanized 10F7 antibody based on the VH and VL shuffling are listed in the table below.

TABLE 10

|  | 10F7 Vk | h10F7 Vk.1 | h10F7 Vk.1a | h10F7 Vk.1b | h10F7 Vk.1c | h10F7 Vk.2 | h10F7 Vk.2a | h10F7 Vk.2b |
|---|---|---|---|---|---|---|---|---|
| 10F7VH |  |  | 4 |  |  |  | 9 |  |
| h10F7VH.1 | 18 | 2 | 5 | 12 | 14 | 7 | 10 | 16 |
| h10F7VH.1a | 1 | 3 | 6 | 13 | 15 | 8 | 11 | 17 |

VH.1a contains 4 back-mutations (M48I, V67A, I69L, A93T)

Vk.1a contains 4 back-mutations (M4L, Y36F, A43S, L47W)

Vk.1b contains two additional back-mutations (D1Q and Q3V)

Vk.1c changed the back-mutation D1Q to D1E to avoid pyroglutamate

Vk.2a contains 4 back-mutations (Y36F, L46R, L47W, K49Y)

Vk.2b contains one additional back-mutations (E1Q)

The following humanized variable regions of the murine monoclonal antibody 5C5 were cloned into IgG expression vectors for functional characterization.

TABLE 11

| SEQ ID No. | Protein region | Sequence 123456789012345678901234567890 |
|---|---|---|
| 69 | h5C5VH.1 | EVQLVQSGAEVKKPGASVKVSCKASGYTFTDYEFHWVRQAPGQGLEWMGVIHPGNGGTAYNQ NFRDRVTITADKSTSTAYMELSSLRSEDTAV YYCARFLTYEGYFDYWGQGTLVTVSS |
| 70 | h5C5VH.1a | EVQLVQSGAEVKKPGASVKVSCKASGGTFTDYEFHWVRQAPGQGLEWIGVIHPGNGGTAYNQ NFRDRATLTADKSTSTAYMELSSLRSEDTAV YYCTRFLTYEGYFDYWGQGTLVTVSS |
| 931 | h5C5VH.1b | EVQLVQSGAEVKKPGASVKVSCKASGYTFTDYEFHWVRQAPGQGLEWIGVIHPGNGGTAYNQ NFRDRATLTADKSTSTAYMELSSLRSEDTAV YYCTRFLTYEGYFDYWGQGTLVTVSS |
| 71 | h5C5Vk.1 | DIQMTQSPSSLSASVGDRVTITCKASQSVSI DVGWYQQKPGKAPKLLIYHASNRYTGVPSRF SGSGSGTDFTFTISSLQPEDFATYYCQQDYS SPYTFGQGTKLEIKR |
| 72 | h5C5Vk.1a | DIQMTQSPSSLSASVGDRVTITCKASQSVSI DVGWFQQKPGKSPKLLIYHASNRYTGVPSRF SGSGSGTDFTFTISSLQPEDFATYFCQQDYS SPYTFGQGTKLEIKR |
| 73 | h5C5Vk.1b | NIVMTQTPSSLSASVGDRVTITCKASQSVSI DVGWFQQKPGKSPKLLIYHASNRYTGVPSRF SGSGSGTDFTFTISSLQPEDFATYFCQQDYS SPYTFGQGTKLEIKR |
| 932 | h5C5Vk.1c | NIVMTQSPSSLSASVGDRVTITCKASQSVSI DVGWFQQKPGKSPKLLIYHASNRYTGVPSRF SGSGSGTDFTFTISSLQPEDFATYFCQQDYS SPYTFGQGTKLEIKR |
| 74 | h5C5Vk.3 | EIVMTQSPATLSVSPGERATLSCKASQSVSI DVGWYQQKPGQAPRLLIYHASNRYTGIPARF SGSGSGTDFTLTISSLQPEDFAVYYCQQDYS SPYTFGQGTKLEIKR |
| 75 | h5C5Vk.3a | EIVMTQSPATLSVSPGERATLSCKASQSVSI DVGWFQQKPGQSPRLLIYHASNRYTGVPARF SGSGSGTDFTLTISSLQPEDFAVYFCQQDYS SPYTFGQGTKLEIKR |
| 76 | h5C5Vk.3b | NIVMTQTPATLSVSPGERATLSCKASQSVSI DVGWFQQKPGQSPRLLIYHASNRYTGVPARF SGSGSGTDFTLTISSLQPEDFAVYFCQQDYS SPYTFGQGTKLEIKR |
| 933 | h5C5Vk.3c | NIVMTQSPATLSVSPGERATLSCKASQSVSI DVGWFQQKPGQSPRLLIYHASNRYTGVPARF SGSGSGTDFTLTISSLQPEDFAVYFCQQDYS SPYTFGQGTKLEIKR |

TABLE 12

|  | 5C5 Vk | h5C5 Vk.1 | h5C5 Vk.1a | h5C5 Vk.1c | h5C5 Vk.3 | h5C5 Vk.3a | h5C5 Vk.3c |
|---|---|---|---|---|---|---|---|
| 5C5VH | 1 | 4 | 7 | 16 | 10 | 13 | 19 |
| h5C5VH.1 | 2 | 5 | 8 | 17 | 11 | 14 | 20 |
| h5C5VH.1b | 3 | 6 | 9 | 18 | 12 | 15 | 21 |

VH.1b contains 4 back-mutations (M48I, V67A, I69L, A93T)
Vk.1a contains 3 back-mutations (Y36F, A43S, Y87F)
Vk.1c contains two additional back-mutations (D1N, Q3V)
Vk.3a contains 4 back-mutations (Y36F, A43S, I58V, Y87F)
Vk.3c contains one additional back-mutation (E1N)

1.5: Functional Characterization of Mouse and Humanized IL-17 Antibodies 1.5.1: IL-17 Enzyme-Linked Immunosorbent Assay Protocol (ELISA)

The following protocol is used to characterize the binding of IL-17 antibodies to human IL-17 by enzyme-linked immunosorbent assay (ELISA).

1. Coat ELISA plate with 50 μl per well of Goat anti Mouse IgG-Fc at 2 ug/ml, overnight at 4° C. (Jackson cat#115-005-164).
2. Wash plate 3×PBS/Tween.
3. Add 50ul Mab diluted to 1 μg/ml in PBS/0.1% BSA to appropriate wells. Incubate 1 hr at room temperature (RT).
4. Wash plate 3× with PBS/Tween.
5. Add 50 μl of serial diluted biotin-IL17 (human IL-17, IL-17A/F, cyno IL-17) to appropriate wells. Incubate 1 hr at room temperature (RT).
6. Wash plate 3× with PBS/Tween.
7. Add 50 μl of Streptavidin (Thermo Scientific cat#21126) diluted 1:10,000 in PBS/0.1% BSA. Incubate 1 hr at RT.
8. Wash plate 3× with PBS/Tween.
9. Add 50 μl of TMB (Zymed cat#002023), allow reaction to proceed for 1 minute.
10. Stop reaction with 50 μl 2NH$_2$SO$_4$.
11. Read absorbance at 450 nm.

TABLE 13

Binding of mouse antibodies to human IL-17 by ELISA

| | EC 50 nMoles | | |
|---|---|---|---|
| Mab | Hu A/A | Cyno A/A | Hu A/F |
| ML109-12H9 | 1.60 | 2.10 | 2.21 |
| ML109-8A9 | 0.76 | 0.64 | 0.73 |
| ML109-6C6 | 0.56 | 0.44 | 0.63 |
| ML109-10G9 | 0.83 | 1.10 | 1.17 |
| ML109-1D8 | 0.59 | 0.37 | 0.54 |
| ML109-8B12 | 1.01 | 1.50 | 1.13 |
| ML109-7D7 | 0.93 | 0.62 | 0.56 |
| ML109-10F7 | 0.54 | 0.67 | 0.75 |
| ML109-5C5 | 0.76 | 0.78 | 0.74 |
| ML107-14F1 | 0.46 | 0.95 | 0.88 |

TABLE 14

Binding of humanized antibodies to human IL-17 by ELISA

| Antibody Name | EC50 in hIL17A ELISA (nM) |
|---|---|
| IL17-h10F7.1 | 1.7 |
| IL17-h10F7.2 | >9398 |
| IL17-h10F7.3 | 0.05 |
| IL17-h10F7.4 | 0.04 |
| IL17-h10F7.5 | 0.06 |
| IL17-h10F7.6 | 0.05 |
| IL17-h10F7.7 | 0.05 |
| IL17-h10F7.8 | 3.9 |
| IL17-h10F7.9 | 0.04 |
| IL17-h10F7.10 | 0.04 |
| IL17-h10F7.11 | 0.10 |
| IL17-h10F7.12 | 0.14 |
| IL17-h10F7.13 | 0.10 |
| IL17-h10F7.14 | 0.13 |
| IL17-h10F7.15 | 0.14 |
| IL17-h10F7.16 | 0.09 |
| IL17-h10F7.17 | 0.10 |
| IL17-h5C5.1 | 1 |
| IL17-h5C5.2 | 1.2 |
| IL17-h5C5.3 | 1.37 |
| IL17-h5C5.5 | 0.05 |

TABLE 14-continued

Binding of humanized antibodies to human IL-17 by ELISA

| Antibody Name | EC50 in hIL17A ELISA (nM) |
|---|---|
| IL17-h5C5.6 | 0.11 |
| IL17-h5C5.7 | 0.03 |
| IL17-h5C5.8 | 0.07 |
| IL17-h5C5.9 | 0.03 |
| IL17-h5C5.10 | 0.05 |
| IL17-h5C5.11 | 0.03 |
| IL17-h5C5.12 | 0.23 |
| IL17-h5C5.13 | 0.03 |
| IL17-h5C5.14 | 0.03 |
| IL17-h5C5.15 | 0.02 |
| IL17-h5C5.16 | 0.02 |
| IL17-h5C5.17 | 0.03 |
| IL17-h5C5.18 | 0.03 |
| IL17-h5C5.19 | 0.03 |
| IL17-h5C5.20 | 0.03 |
| IL17-h5C5.21 | 0.03 |

1.5.2: Assay for IL-17A and IL-17A/F Induced IL-6 Secretion in Primary Human Foreskin Fibroblasts HS27

The human HS27 cell line (ATCC Accession # CRL-1634) secretes IL-6 in response to IL-17. The IL-17-induced IL-6 secretion is inhibited by neutralizing anti-IL-17 antibodies (See, e.g., *J. Immunol.*, 155: 5483-5486 (1995); *Cytokine*, 9: 794-800 (1997)).

HS27 cells were maintained in assay medium: DMEM high glucose medium (Gibco #11965) with 10% fetal bovine serum (Gibco#26140), 4 mM L-glutamine, 1 mM sodium pyruvate, penicillin G (100 U/500 ml) and streptomycin (100 µg/500 ml). Cells were grown in T150 flasks until they were about 80-90% confluent the day of the assay. Human IL-17A (R&D Systems, #317-IL/CF), or cynomolgous monkey (cyno) IL-17A (generated at Abbott) was reconstituted in sterile PBS without $Ca^{2+}$ and $Mg^{2+}$ stored frozen, freshly thawed for use and diluted to 240 pM (4×) or 4 nM (4×) for IL-17A/F in assay medium. Serial dilutions of antibodies were made in a separate plate (4× concentrations), mixed with equal volume of 240 pM (4×) of huIL-17 or cynoIL-17A or 4 nM (4×) huIL-17A/F and incubated at 37° C. for 1 hr. HS27 cells (typically about 20,000 cells in 50 µl assay medium) were added to each well of a 96-well flat-bottom tissue culture plate (Costar #3599), followed by addition of 50 µl of the pre-incubated antibody plus IL-17 mix. The final concentration of human and cynoIL-17A was 60 pM. The final concentration of human IL-17A/F was 1 nM. Cells were incubated for about 24 hrs at 37° C. The media supernatants were then collected. The level of IL-17 neutralization was measured by determination of IL-6 amounts in supernatant using a commercial Meso Scale Discovery kit (cat# L411AKB-1) according to manufacturer's instruction. IC50 values were obtained using logarithm of antibody versus IL-6 amount variable slope fit.

1.5.3: Assay for IL-17 and TNF-α Induced IL-6 Secretion from Murine Embryonic Fibroblast Cell Line (NIH3T3)

The murine NIH3T3 cell line (ATCC Accession # CRL-1658) secretes IL-6 in response to murine, rat, or rabbit IL-17A and murine TNFα (R&D Systems, Cat#410-MT). The IL-17 induced IL-6 secretion is inhibited by neutralizing anti-IL-17 antibodies.

NIH3T3 cells were maintained in assay medium: DMEM (Invitrogen Cat#11965-092) with 10% fetal bovine serum (Gibco#26140-079), 1% Non Essential Amino Acids, 2 mM L-glutamine, 1 mM sodium pyruvate, penicillin G (100 U/500 ml), and streptomycin (100 µg/500 ml). Cells were grown in T150 flasks until they were about 80-90% confluent the day of the assay. Rat IL17A (Prospec bio, Cat# CYT-542) was reconstituted in sterile PBS, without Ca2+ and Mg2+, with 0.1% BSA, aliquoted and stored frozen at 100 µg/mL. Rabbit IL17A (Abbott, A-1239293.0) was aliquoted and stored frozen at 260 µg/mL. Murine TNF-α was reconstituted in 0.1% BSA/PBS without $Ca^{2+}$ and $Mg^{2+}$ at a concentration of 10 µg/mL, aliquoted, and stored frozen. Freshly thawed IL-17 antibodies were diluted to 200 µg/ml (4×) in assay medium. Serial dilutions of antibodies were made in a separate plate (4× concentrations), mixed with equal volume of 40 ng/ml (4×) murine or rat IL-17A or 100 ng/mL rabbit IL-17A, and incubated at 37° C. for 1 hr.

NIH3T3 cells (typically about 400,000 cells in 50 µl assay medium) were added to each well of a 96-well flat-bottom tissue culture plate (Costar #3599), followed by addition of 50 µl of the pre-incubated antibody plus IL-17 mix. Mu TNF-α at 5.5 ng/mL (10×) was added in 11 µl of media to each well. The final concentration of IL-17A was 10 ng/ml for murine and rat and 25 ng/mL for rabbit. The final concentration for mu TNFα was 0.55 ng/mL. Cells were incubated for about 24 hrs at 37° C. The media supernatants were then collected. The level of IL-17 neutralization was measured by determination of IL-6 amounts in supernatant using a commercial Meso Scale Discovery kit (cat# K112AKA-4) according to manufacturer's instruction. IC50 values were obtained using logarithm of antibody versus IL-6 amount variable slope fit.

1.5.4: Affinity Measurement of IL-17 Antibodies by Surface Plasmon Resonance

The binding of antibodies to purified recombinant human, cyno, rat, mouse, rabbit IL-17 and human IL-17A/F were determined by surface plasmon resonance-based measurements with a Biacore® 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. All chemicals were obtained from Biacore® AB (Uppsala, Sweden) or otherwise from a different source as described in the text. Approximately 5000 RU of goat anti-mouse or anti-human IgG (Fcγ) fragment specific polyclonal antibody (Pierce Biotechnology Inc, Rockford, Ill.) diluted in 10 mM sodium acetate (pH 4.5) was directly immobilized across a CM5 research grade biosensor chip using a standard amine coupling kit according to manufacturer's instructions and procedures at 25 µg/ml. Unreacted moieties on the biosensor surface were blocked with ethanolamine Modified carboxymethyl dextran surface in flowcell 2 and 4 was used as a reaction surface. Unmodified carboxymethyl dextran without goat anti-mouse or anti-human IgG in flow cell 1 and 3 was used as the reference surface. For kinetic analysis, rate equations derived from the 1:1 Langmuir binding model were fitted simultaneously to association and dissociation phases of all eight injections (using global fit analysis) with the use of Biaevaluation 4.0.1 software. Purified antibodies were diluted in HEPES-buffered saline for capture across goat anti-mouse or anti-human IgG specific reaction surfaces. Antibodies to be captured as a ligand (25 µg/ml) were injected over reaction matrices at a flow rate of 5 µL1/min. The association and dissociation rate constants, kon (unit M-1s-1) and koff (unit s-1) were determined under a continuous flow rate of 25 µl/min. Rate constants were derived by making kinetic binding measurements at ten different antigen concentrations ranging from 10 nM to 200 nM. The equilibrium dissociation constant (unit M) of the reaction between antibodies and recombinant purified IL-17 antigens was then calculated from the kinetic rate constants by the following formula: $K_D$=koff/kon. Binding was recorded as a function of time and kinetic rate constants are calculated. In this assay, on-rates as fast as $10^6$ $M^{-1}s^{-1}$ and off-rates as slow as $10^{-6}s^{-1}$ can be measured.

1.5.5: Neutralizing Potency of Mouse Anti-Human IL-17 Antibodies

Potency of anti-IL-17 antibodies was assessed using IL-17-driven IL-6 production in HS27 cells for human and cyno antigens or IL-17 (according to the assay described above, Example 1.5.2.). The table below summarizes potencies to human IL-17A.

TABLE 15

| Hybridoma-derived anti-IL-17 MAb | Potency (pM) Hu IL-17A |
|---|---|
| 1D8.4B10 | 62 |
| 10G9.3B11 | 131 |
| 6C6.3B4 | 36 |
| 12H9.3B5 | 937 |
| 8A9.5C7 | 415 |
| 8B12.4H2 | 137 |
| 7D7.3C5 | 81 |
| 5C5.3A8 | 23 |
| 10F7.3D1 | 54 |
| 14F1.5F4.3A7 | 450 |

1.5.6: Neutralizing Potency of Humanized IL-17 Antibodies of the 10F7 Lineage

Potency of the humanized 10F7 antibodies was assessed using IL-17-driven IL-6 production in HS27 cells for human and cyno antigens (assay described above, Example 1.5.2) or IL-17 and TNF-α-driven IL-6 production in NIH3T3 cells (assay described above, Example 1.5.3) for rat, mouse, and rabbit antigens. The table below summarizes potencies to human, cyno and rat IL-17A. Only active humanized antibodies were tested for their potencies.

TABLE 16

| Humanized Anti-IL-17 MAb | Potency (pM) | | |
|---|---|---|---|
| | Hu IL-17A | Cyno IL-17A | Rat IL-17A |
| h10F7.4 | 117 | ND | ND |
| h10F7.6 | 264 | 313 | ND |
| h10F7.9 | 293 | ND | ND |
| h10F7.11 | 326 | 622 | ND |
| h10F7.13 | 242 | 429 | ND |
| h10F7.15 | 309 | 499 | ND |
| h10F7.17 | 510 | 293 | 9118 |
| m10F7hIgG1 | 40 | 79 | ND |

Note:
m10FhIgG1 is a chimeric antibody containing the murine 10F7 variable domains.
ND: not determined.

1.5.7: Neutralizing Potency of Humanized IL-17 Antibodies of the 5C5 Lineage

Potency of the humanized 5C5 antibodies was assessed using IL-17-driven IL-6 production in HS27 cells for human and cyno antigens (assay described above, Example 1.5.2) or IL-17 and TNF-α-driven IL-6 production in NIH3T3 cells for rat, mouse and rabbit antigens (assay described above, Example 1.5.3). The table below summarizes potencies to human, cyno, and rat IL-17A. Only active humanized antibodies were tested for their potencies.

TABLE 17

| Humanized Anti-IL-17 MAb | Potency (pM) | | |
|---|---|---|---|
| | Hu IL-17A | Cyno IL-17A | Rat IL-17A |
| h5C5.2 | 6 | 11 | ND |
| h5C5.3 | 5 | 12 | 2519 |
| h5C5.8 | 17 | 20 | 13080 |
| h5C5.9 | 14 | 19 | 5678 |
| h5C5.11 | 115 | 90 | ND |
| h5C5.14 | 18 | 16 | ND |
| h5C5.15 | 13 | 12 | ND |
| h5C5.19 | 11 | 9 | ND |
| h5C5.20 | 12 | 13 | ND |
| h5C5.21 | 9 | 9 | ND |
| m5C5.hIgG1 | 11 | ND | 4911 |

Note:
m5C5.hIgG1 is a chimeric antibody containing the murine 5C5 variable domains.
ND: not determined 1.5.8: Affinity Measurement of IL-17 Antibodies by Surface Plasmon Resonance The binding of antibodies to purified recombinant human (HuIL-17A), cyno (Cyno IL-17A), rat (RatIL-17A), mouse (MuIL-17A), rabbit IL-17 (RabIL-17A), and human IL-17A/F (HuIL-17A/F) were determined by surface plasmon resonance-based measurements with a Biacore® 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. as described above (Example 1.5.4). The tables below show the affinity measurements for selected mouse monoclonal and humanized anti-human IL-17A antibodies.

TABLE 18

| Mouse Antibody | IL-17 Antigen | | | | | |
|---|---|---|---|---|---|---|
| | HuIL-17A | HuIL-17A/F | Cyno IL-17A | RatIL-17A | MuIL-17A | RabIL-17A |
| 10F7 (M) | 6.26E−11 | 6.73E−10 | 6.84E−11 | 1.97E−10 | 2.21E−10 | ND |
| Kon (1/Ms) | 2.54E+06 | 1.02E+06 | 2.12E+06 | 3.17E+06 | 1.60E+06 | |
| Koff (1/s) | 1.59E−04 | 6.86E−04 | 1.45E−04 | 6.23E−04 | 3.54E−04 | |
| 6C6 (M) | 1.87E−11 | 1.89E−10 | 4.25E−11 | 1.42E−10 | 3.57E−10 | ND |
| Kon (1/Ms) | 3.63E+06 | 1.94E+06 | 2.73E+06 | 4.95E+06 | 2.44E+06 | |
| Koff (1/s) | 6.78E−05 | 3.66E−04 | 1.16E−04 | 7.04E−04 | 8.70E−04 | |

TABLE 19

| Humanized Antibody | IL-17 Antigen | | | | | |
|---|---|---|---|---|---|---|
| | HuIL-17A | HuIL-17A/F | Cyno IL-17A | RatIL-17A | MuIL-17A | RabIL-17A |
| h5C5.8 (VH.1-Vk.1a) (M) | 3.93E−10 | 1.28E−09 | 2.17E−10 | 1.42E−08 | 1.86E−09 | ND |
| Kon (1/Ms) | 1.13E+06 | 9.48E+05 | 1.04E+06 | 7.74E+05 | 2.85E+05 | |
| Koff (1/s) | 4.44E−04 | 1.21E−03 | 2.26E−04 | 1.10E−02 | 5.31E−04 | |
| h5C5.9 (VH.1b-Vk.1a) (M) | 4.40E−10 | 1.21E−09 | 2.28E−10 | 8.48E−09 | 2.09E−09 | ND |
| Kon (1/Ms) | 1.02E+06 | 9.50E+05 | 1.05E+06 | 1.13E+06 | 2.79E+05 | |
| Koff (1/s) | 4.49E−04 | 1.15E−03 | 2.39E−04 | 9.58E−03 | 5.82E−04 | |
| h5C5.14 (VH.1-Vk.3a) (M) | 3.63E−10 | 1.11E−09 | 2.45E−10 | 5.56E−09 | 1.86E−09 | ND |
| Kon (1/Ms) | 1.30E+06 | 1.07E+06 | 9.34E+05 | 7.16E+05 | 2.66E+05 | |
| Koff (1/s) | 4.72E−04 | 1.19E−03 | 2.29E−04 | 3.98E−03 | 4.94E−04 | |
| h5C5.15 (VH.1b-Vk.3a) (M) | 4.58E−10 | 1.43E−09 | 3.58E−10 | 5.80E−09 | 2.83E−09 | ND |
| Kon (1/Ms) | 9.54E+05 | 7.81E+05 | 6.03E+05 | 6.21E+05 | 1.97E+05 | |
| Koff (1/s) | 4.37E−04 | 1.12E−03 | 2.16E−04 | 3.60E−03 | 5.57E−04 | |
| h5C5.18 (VH.1b-Vk.1c) (M) | 5.21E−10 | 1.31E−09 | 4.37E−10 | 9.15E−09 | 2.91E−09 | ND |
| Kon (1/Ms) | 9.47E+05 | 7.72E+05 | 5.81E+05 | 4.60E+05 | 1.72E+05 | |
| Koff (1/s) | 4.93E−04 | 1.01E−03 | 2.54E−04 | 4.21E−03 | 5.00E−04 | |
| h5C5.21 (VH.1b-Vk.3c) (M) | 7.29E−10 | 1.39E−09 | 4.06E−10 | 5.97E−09 | 3.06E−09 | ND |
| Kon (1/Ms) | 5.42E+05 | 8.01E+05 | 5.91E+05 | 4.02E+05 | 1.71E+05 | |
| Koff (1/s) | 3.95E−04 | 1.11E−03 | 2.40E−04 | 2.40E−03 | 5.24E−04 | |
| h10F7.6 (VH.1a-Vk.1a) (M) | 3.02E−10 | 1.14E−09 | 2.17E−10 | 9.19E−10 | 9.80E−10 | ND |
| Kon (1/Ms) | 6.12E+05 | 6.09E+05 | 7.11E+05 | 4.94E+05 | 3.92E+05 | |
| Koff (1/s) | 1.85E−04 | 6.96E−04 | 1.54E−04 | 4.54E−04 | 3.84E−04 | |
| h10F7.11 (VH.1a-Vk.2a) (M) | 5.24E−10 | 2.11E−09 | 7.73E−10 | 3.77E−09 | 2.21E−09 | ND |
| Kon (1/Ms) | 2.71E+05 | 4.08E+05 | 4.54E+05 | 1.77E+05 | 2.36E+05 | |
| Koff (1/s) | 1.42E−04 | 8.60E−04 | 3.51E−04 | 6.67E−04 | 5.22E−04 | |

ND: Not determined.

Example 2

Fully Human Anti-IL-17 Antibodies 2.1 Generation of Affinity-Matured Fully Human IL-17 Antibodies from IL17-TN-L7-G9 and from IL17-K7-B6.

Fully human anti hIL-17 monoclonal antibodies IL17-TN-L7-G9, IL-17-TN-L7-A7, IL-TN-L7-C8, IL17-TN-K7-B6, and IL17-LN-K9-F5 were isolated by PROfusion mRNA display technology from human antibody libraries by their ability to bind human IL-17 proteins. The amino acid sequences of the variable heavy (VH) and variable light (VL) chains were determined from DNA sequencing. See, Table 6.

The IL17-TN-L7-G9 human antibody to human IL-17 was subsequently affinity matured by PROfusion mRNA display technology. One light chain library was constructed to contain limited mutagenesis at the following residues: CDRL1: 26, 26, 30, 31, 32, 34; CDRL2: 50, 51, 52, 53; CDRL3: 89, 90, 94, 95a, 95b, 96 (Kabat numbering). This library also contained G3V framework germline back-mutations as well as binary diversities at position 48(I/M), 64(G/V), 66(K/Q), and 100(S/T) to allow for framework germ-lining during library selections. Two heavy chain libraries were made to contain limited mutagenesis in CDRH1 and CDRH2 at residues 30, 31, 32, 50, 52, 52a, 55, 56, 57, 58, and 60 (Kabat numbering) or in CDRH3 at residues 95-100, 100a-100 g, and 102. All three libraries were selected separately for the ability to bind IL-17 in the presence of decreasing concentrations of biotinylated human IL-17, cyno IL-17, or human IL-17A/F and recovered by magnetic streptavidin particles (Invitrogen). All mutated CDR sequences were then recombined into one library and the recombined library is subjected to more stringent selection conditions before individual antibodies are identified.

The table below provides a list of amino acid sequences of VH and VL of the fully human G9 antibody which were subjected to the affinity maturation selection protocol. Amino acid residues of individual CDRs of each VH and VL sequence are indicated in bold.

TABLE 20

List of Amino Acid Sequences of VH and VL regions of fully human IL17-TN-L7-G9.

| SEQ ID No. | Protein region | Sequence 12345678901234567890123456789 0 |
|---|---|---|
| 77 | VH G9 | EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |

TABLE 20-continued

List of Amino Acid Sequences of VH and VL regions of fully human IL17-TN-L7-G9.

| SEQ ID No. | Protein region | | Sequence 12345678901234567890123456789 0 |
|---|---|---|---|
| | VH G9 CDR-H1 | Residues 31-35 of SEQ-ID NO: 77 | NYGMN |
| | VH G9 CDR-H2 | Residues 50-66 of SEQ-ID NO: 77 | VISYDGSNKYYADSVKG |
| | VH G9 CDR-H3 | Residues 99-113 of SEQ-ID NO: 77 | VGASGDYYYSYGLDV |
| 78 | VL G9 | | QSVLTQPPSASGTPGQTVSISCSGSNSNIG SHSVNWYQQVPGAAPKLLMYGIGQRPSGVP DRFSVSQSGTSASLAISGLQSEDEADYYCA TWDDSLGGYVFGSGTKVTVLG |
| | VL G9 CDR-L1 | Residues 23-35 of SEQ-ID NO: 78 | SGSNSNIGSHSVN |
| | VL G9 CDR-L2 | Residues 51-57 of SEQ-ID NO: 78 | GIGQRPS |
| | VL G9 CDR-L3 | Residues 90-100 of SEQ-ID NO: 78 | ATWDDSLGGYV |

In Table 20, the amino acid sequence for VL G9 (SEQ ID NO:78) contains the G3V framework germline backmutation, mentioned above, of the VL (SEQ ID NO:41) of fully human IL17-TN-L7-G9 shown in Table 6.

The table below provides a list of amino acid sequences of VH and VL regions of affinity matured fully human IL-17 antibodies derived from IL17-TN-L7-G9. Amino acid residues of individual CDRs of each VH and VL sequence are indicated in bold.

TABLE 21

List of amino acid sequences of affinity matured G9 VH/VL variants

| SEQ ID NO: | Protein region | Sequence 12345678901234567890123456789 0 |
|---|---|---|
| 79 | G9 VH #1 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 80 | G9 VL #1 | QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGSGTKVTVL |
| 81 | G9 VH #2 | EVQLLESGGGVVQPGRSLRLSCAASGFIFSN YGMHWVRQAPGKGLEWVAVISYDGSNAYYAD SVKGRFTISRDNSKNTLYLEMNSLRPEDTAV YYCAKVGASGDYYYSYGLDVWGQGTTVTVSS |
| 82 | G9 VL #2 | Same as VL #1 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGSGTKVTVL |
| 83 | G9 VH #3 | EVQLLESGGGVVQPGRSLRLSCAASGFIFGN YGMHWVRQAPGKGLEWVA**VISYDGSNKYYAD |

TABLE 21-continued

List of amino acid sequences of affinity matured G9 VH/VL variants

| SEQ ID NO: | Protein region | Sequence 12345678901234567890123456789 0 |
|---|---|---|
| | | SVKGRFTISRDNSKNTLYLEMNSPRPEDTAV YYCAKVGASGDYYYSYGLDVWGQGTTVTVSS |
| 84 | G9 VL #3 | QSVLTQPPSASGTPGQTVSISCSGRQSNIGR HYVDWYEQVPGAAPKLLMYYDSIRPSGVPDR FSGSQSGTSASLAISGLQSEDEADYYCGMWD DSLAGYVFGSGTKVTVL |
| 85 | G9 VH #4 | EVQLLESGGGVVQPGRSLRLSCAASGFIFRN YGMHWVRQAPGKGLEWVAVIAYDGSRQYYSD SVKGRFTISRDNSKNTLYLEMNSLRPEDTAV YYCAKVGASGDYYYSYGLDLWGQGTTVTVSS |
| 86 | G9 VL #4 | QSVLTQPPSASGTPGQTVSISCSGRQSNIGR HYVDWYQQVPGAAPKLLMYYDSIRPSGVPDR FSGSQSGTSASLAISGLQSEDEADYYCGMWD DSLAGYVFGSGTKVTVL |
| 87 | G9 VH #5 | EVQLLESGGGVVQPGRSLRLSCAASGFIFSN HGMHWVRQAPGKGLEWVAVIASDGSNKYYAD SVKGRFTISRDNSKNTLYLEMNSLRPEDTAV YYCAKVGASGDYYYSYGLDVWGRGTTVTVSS |
| 88 | G9 VL #5 | Same as VL #1 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGSGTKVTVL |
| 89 | G9 VH #6 | EVQLLESGGGVVQPGRSLRLSCAASGFIFSN YGMHWVRQAPGKGLEWVAVISYDGSNKYYAD SVKGRFTISKDNSKNTLHLEMNSLRPEDTAV YYCAKVGASGDYYYSYGLDVWGQGTTVTVSS |
| 90 | G9 VL #6 | QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |

TABLE 21-continued

List of amino acid sequences of affinity matured G9 VH/VL variants

| SEQ ID NO: | Protein region | Sequence 123456789012345678901234567890 |
|---|---|---|
| 100 | G9 VH #7 | Same as Parental EVQLLESGGGVVQPGRSLRLSCAASGFIFSN YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 101 | G9 VL #7 | Same as VL #6 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |
| 102 | G9 VH #8 | EVQLLESGGGVVQPGRSLRLSCAASGFIFSN YGMHWVRQAPGKGLEWVAVISYDGSNKYYAD SVKGRFTISRDNSKNTLYLEMNSLRPKDTAV YYCAKVGASGDYYYSYGLDVWGQGTTVTVSS |
| 103 | G9 VL #8 | Same as VL #6 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |
| 104 | G9 VH #9 | EVQLLESGGGVVQPGRSLRLSCAASGFIFSN YGMHWVRQAPGKGLEWVAVISFDGSNKYYPD SVKGRFTISRDNSKNTLYLEMNSLRPEDTAV YYCAKVGASGDYYYSYGLDVWGQGTTVTVSS |
| 105 | G9 VL #9 | QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVLGTGTKVTVL |
| 106 | G9 VH #10 | EVQLLESGGGVVQPGRSLRLSCAASGFIFTN YGMHWVRQAPGKGLEWVAVISFDGSNRYYAD SVKGRFTISRDNSKNTLYLEMNSLRPEDTAV YYCAKVGASGDYYYSYGLDVWGQGTTVTVSS |
| 107 | G9 VL #10 | Same as VL #6 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |
| 108 | G9 VH #11 | EVQLLESGGGVVQPGRSLRLSCAASGFIFSN YGMHWVRQAPGKGLEWVAVISYDGRNKYYED SVKGRFTISRDNSKNTLYLEMNSLRPEDTAV YYCAKVGASGDYYYSYGLDVWGQGTTVTVSS |
| 109 | G9 VL #11 | QSVLTQPPSASGTPGQTVSISCSGRQSNIGR HYVDWYQQVPGAAPKLLMYYDSIRPSGVPDR FSGSQSGTSASLVISGLQSEDEADYYCATWD DSLGGYVFGTGTKVTVL |
| 110 | G9 VH #12 | EVQLLESGGGVVQPGRSLRLSCAASGFIFRN YGMHWVRQAPGKGLEWVAVISYDGRNKYYTD SVKGRFTISRDNSKNTLYLEMNSLRPEDTAV YYCAKVGASGDYYYSYGLDVWGQGTTVTVSS |
| 111 | G9 VL #12 | Same as VL #1 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGSGTKVTVL |
| 112 | G9 VH #13 | EVQLLESGGGVVQPGRSLRLSCAASGFIFRN YGMHWVRQAPGKGLEWVAVISYDGTNTYYAD SVKGRFTISRDNSKNTLYLEMNSLRPEDTAV YYCAKVGASGDYYYSYGLDVWGQGTTVTVSS |
| 113 | G9 VL #13 | Same as VL #6 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |
| 114 | G9 VH #14 | EVQLLESGGGVVQPGRSLRLSCAASGFIFRN YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 115 | G9 VL #14 | Same as VL #6 QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGTGTKVTVL |
| 116 | G9 VH #15 | EVQLLESGGGVVQPGRSLRLSCAASGFIFSN YGMHWVRQAPGKGLEWVAVISNDGSNTYYAD SVKGRFTISRDNSENTLYLEMNSLRPEDTAV YYCAKVGASGDYYYSYGLDVWGQGTTVTVSS |
| 117 | G9 VL #15 | QSVLTQPPSASGTPGQTVSISCSGRQSNIGR HYVDWYQQVPGAAPKLLMYYDSIRPSGVPDR FSGSQSGTSASLAISGLQSEDEADYYCATWD DWLAGYVFGTGTKVTVL |
| 118 | G9 VH #16 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 119 | G9 VL #16 | QSVLTQPPSASGTPGQTVSISCSGRQSNIGR HYVDWYQQVPGAAPKLLMYYDSIRPSGVPDR FSGSQSGTSASLAISGLQSEDEADYYCATWD DFLAGYVFGTGTKVTVL |
| 120 | G9 VH #17 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 121 | G9 VL #17 | QSVLSQPPSASGTPGQTVSISCSGTNSNIGR HAVDWYQQVPGAAPKLLMYYDSIRPSGVPDR FSGSQSGTSASLAISGLQSEDEADYYCATWD DSLGGYVFGTGTKVTVL |
| 122 | G9 VH #18 | EVQLLESGGGVVQPGRSLRLSCAASGFIFRN NGMHWVRQAPGKGLEWVAVISRDGSNKYYAD SVKGRFTISRDNSKNTLYLEMNRLRPEDTAV YYCAKVGASGDYYYSYGLDVWGQGTTVTVSS |
| 123 | G9 VL #18 | QSVLTQPPSASGTPGQTVSISCSGRQSNIGN HYVDWYQQVPGAAPKLLIYGDVIRPSGVPDR FSGSQSGTSASLAISGLQSEDEADYYCATWD DWLAGYVFGTGTKVTVL |
| 124 | G9 VH #19 | EVQLLESGGGVVQPGRSLRLSCAASGFIFSN YGMHWVRQAPGKGLEWVAVISYDGSNSYYAD SVKGRFTISRDNSKNTLYLEMNSLRPEDTAV YYCAKVGASGDYYYSYGLDVWGQGTTVTVSS |
| 125 | G9 VL #19 | Same as VL #18 EVQLLESGGGVVQPGRSLRLSCAASGFIFRN NGMHWVRQAPGKGLEWVAVISRDGSNKYYAD SVKGRFTISRDNSKNTLYLEMNRLRPEDTAV YYCAKVGASGDYYYSYGLDVWGQGTTVTVSS |
| 126 | G9 VH #20 | EVQLLESGGGVVQPGRSLRLSCAASGFIFSD YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |

TABLE 21-continued

List of amino acid sequences of affinity matured G9 VH/VL variants

| SEQ ID NO: | Protein region | Sequence 12345678901234567890123456 7890 |
|---|---|---|
| 127 | G9 VL #20 | QSVLTQPPSASGTPGQTVSISCSGRQSNIGN HYVDWYQQVPGAAPKLLIYGDVIRPSGVPDR FSGSQSGTSASLAISGLQSEDEADYYCATWD DWLAGYVFGSGTKVTVL |
| 128 | G9 VH #21 | EVQLLESGGGVVQPGRSLRLSCAASGFIFSN YGMHWVRQAPGKGLEWVAVISNDGSNKYYSD SVKGRFTISRDNSKNTLYLEMNSLRPEDTAV YYCAKVGASGDYYYSYGLDVWGQGTTVTVSS |
| 129 | G9 VL #21 | QSGLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 130 | G9 VH #22 | EVQLLESGGGVVQPGRSLRLSCAASGFIFSN YGMHWVRQAPGKGLEWVAVISNDGGNKYYAD SVKGRFTISRDNSKNTLYLEMNSLRPEDTAV YYCAKVGASGDYYYSYGLDVWGQGTTVTVSS |
| 131 | G9 VL #22 | QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 132 | G9 VH #23 | Same as VH #14 EVQLLESGGGVVQPGRSLRLSCAASGFIFRN YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 133 | G9 VL #23 | Same as VL #22 QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 134 | G9 VH #24 | EVQLLESGGGVVQPGRSLRLSCAASGFIFGN YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 135 | G9 VL #24 | Same as VL #22 QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 136 | G9 VH #25 | EVQLLESGGGVVQPGRSLRLSCAASGFIFNN HGMHWVRQAPGKGLEWVAVISYDGWNKYYAD SVKGRFTISRDNSKNTLYLEMNSLRPEDTAV YYCAKVGASGDYYYSYGLDVWGQGTTVTVSS |
| 137 | G9 VL #25 | Same as VL #22 QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 138 | G9 VH #26 | EVQLLESGGGVVQPGRSLRLSCGASGFIFRN YGMHWVRQAPGKGLEWVAVISYDGTSKYYAD SVKGRFTISRDNSKNTLYLEMNSLRPEDTAV YYCAKVGASGDYYYSYGLDVWGQGTTVTVSS |
| 139 | G9 VL #26 | QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGSGTKVTVL |
| 140 | G9 VH #27 | EVQLLESGGGVVQPGRSLRLSCAASGFIFPN YGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 141 | G9 VL #27 | Same as VL #22 QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGTGTKVTVL |
| 142 | G9 VH #26 | Same as Parental EVQLLESGGGVVQPGRSLRLSCAASGFIFSN YGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 143 | G9 VL #28 | QSVLTQPPSASGTPGQTVSISCSGRPSNIGS HAVDWYQQVPGAAPKLLMYYTDLRPSGVPDR FSGSQSGTSASLAISGLQSEDEADYYCATWD DHLAGYVFGTGTKVTVL |
| 144 | G9 VH #29 | EVQLLESGGGVVQPGRSLRLSCAASGFIFSN YGMHWVRQAPGKGLEWVAVISCDGRNKYYAD SVKGRFTISRDNSKNTLYLEMNSLRPEDTAV YYCAKVGASGNYYYSYGLDVWGQGTTVTVSS |
| 145 | G9 VL #29 | QSVLTQPPSASGTPGQTVSISCSGRNSNIGY HTVDWYQQVPGAAPKLLMYYSVQRPSGVPDR FSGSQSGTSASLAISGLQSEDEADYYCASWD DSLGGYVFGTGTKVTVL |
| 146 | G9 VH #30 | EVQLLESGGGVVQPGRSLRLSCAASGFIFSN YGMHWVRQAPGKGLEWVAVISYDGSNRYYAD SVKGRFTISRDNSKNTLYLEMNSLRPEDTAV YYCAKVGASGDYYYSYGLDVWGQGTTVTVSS |
| 147 | G9 VL #30 | QSVLTQPPSASGTPGQTVSISCSGRNSNIGN HPVDWYQQVPGAAPKLLMYYTGIRPSGVPDR FSGSQSGTSASLAISGLQSEDEADYYCASWD DRLGGYVFGTGTKVTVL |
| 148 | G9 VH #31 | EVQLLESGGGVVQPGRSLRLSCAASGFIFSN YGMHWVRQAPGKGLEWVAVIAYDGSNKYYAD SVKGRFTISRDNSKNTLYLEMNSLRPEDTAV YYCAKVGASGDYYYSYGLDVWGQGTTVTVSS |
| 149 | G9 VL #31 | QSVLTQPPSASGTPGQTVSISCSGGKSNIGS HPVDWYQQVPGAAPKLLMYYVGMRPSGVPDR FSGSQSGTSASLAISGLQSEDEADYYCATWD DSLAGYVFGTGTKVTVL |
| 150 | G9 VH #32 | Same as Parental EVQLLESGGGVVQPGRSLRLSCAASGFIFSN YGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 151 | G9 VL #32 | QSVLTQPPSASGTPGQTVSISCSGRNSNIGN HYVDWYQQVPGAAPKLLIYGTGSRPSGVPDR FSGSQSGTSASLAISGLQSEDEADYYCATWD DWLAEYVFGTGTKVTVL |
| 152 | G9 VH #33 | EVQLLESGGGVVQPGRSLRLSCAASGFIFSN NGMHWVRQAPGKGLEWVAVISSDGSHGYYAD SVKGRFTISRDNSKNTLYLEMNSLRPEDTAV YYCAKVGASGDYYYSYGLDVWGQGTTVTVSS |
| 153 | G9 VL #33 | QSVLTQPPSASGTPGQTVSISCSGRMSNIGY HSVDWYQQVPGAAPKLLIYGISQRPSGVPDR FSGSQSGTSASLAISGLQSEDEADYYCATWD DWLAGYVFGTGTKVTVL |

TABLE 21-continued

List of amino acid sequences of affinity matured G9 VH/VL variants

| SEQ ID NO: | Protein region | Sequence 123456789012345678901234567890 |
|---|---|---|
| 154 | G9 VH #34 | EVQLLESGGGVVQPGRSLRLSCAASGFIFSN NGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 155 | G9 VL #34 | QSVLTQPPSASGTPGQTVSISCSGRSSNIGN HSVDWYQQVPGAAPKLLMYGIGQRPSGVPDR FSVSQSGTSASLAISGLQSEDEADYYCATWD DWLGGYVFGTGTKVTVL |
| 156 | G9 VH #35 | EVQLLESGGGVVQPGRSLRLSCAASGFIFNNHGMHWVRQAPGKGLEWVAVISYDGSNKYYAD SVKGRFTISRDNSKNTLYLEMNSLRPEYTAV YYCAKVGASGDYYYSYGLDVWGQGTTVTVSS |
| 157 | G9 VL #36 | QSVLTQPPSASGTPGQTVSISCSGRSSNIGC HAVDWYQQVPGAAPKLLMYGISERPSGVPDR FSGSQSGTSASLAISGLQSEDEADYYCATWD DRLAAYVFGTGTKVTVL |
| 158 | G9 VH #36 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 159 | G9 VL #36 | QSVLTQPPSASGTPGQTVSISCSGRISNIGN HAVDWYQQVPGAAPKLLMYGIGQRPSGVPDR FSGSQSGTSASLAISGLQSEDEADYYCATWD DWLAGYVFGSGTKVTVL |
| 160 | G9 VH #37 | EVQLLESGGGVVQPGRSLRLSCAASGFIFSY HGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 161 | G9 VL #37 | QSVLTQPPSASGTPGQTVSISCSGRNSNIGN HSVYWYQQVPGAAPKLLMYESDQRPSGVPDR FSGSQSGTSASLAISGLQSEDEADYYCATWD DWLGVYVFGSGTKVTVL |
| 162 | G9 VH #38 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 163 | G9 VL #38 | QSVLTQPPSASGTPGQTVSISCSGRRSNIGY HSVDWYQQVPGAAPKLLMYGDDQRPSGVPDR FSGSQSGTSASLAISGLQSEDEADYYCATWD DWLGGYVFGTGTKVTVL |
| 164 | G9 VH #39 | EVQLLESGGGVVQPGRSLRLSCAASGFIFNNYGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 165 | G9 VL #39 | QSVLTQPPSASGTPGQTVSISCSGRNSNIGN HSVDWYQQVPGAAPKLLMYWSGHRPSGVPDR FSGSQSGTSASLAISGLQSEDEADYYCATWD DRLGGYVFGTGTKVTVL |
| 166 | G9 VH #40 | EVQLLESGGGVVQPGRSLRLSCAASGFIFRN YGMHWVRQAPGKGLEWVAVISRDGSGKYYAD SVKGRFTISRDNSKNTLYLEMNSLRPEDTAV YYCAKVGASGDYYYSYGLDVWGQGTTVTVSS |
| 167 | G9 VL #40 | QSVLTQPPSASGTPGQTVSISCSGTNSNIGN HSVDWYQQVPGAAPKLLMYGVGERPSGVPDR FSGSQSGTSASLAISGLQSEDEADYYCATWD DRLGGYVFGTGTKVTVL |
| 168 | G9 VH #41 | Same as VH #39 EVQLLESGGGVVQPGRSLRLSCAASGFIFNNYGMHWVRQAPGKGLEWVAVISYDGSNKYYAD SVKGRFTISRDNSKNTLYLEMNSLRPEDTAV YYCAKVGASGDYYYSYGLDVWGQGTTVTVSS |
| 169 | G9 VL #41 | QSVLTQPPSASGTPGQTVSISCSGRNSNIGS HSVDWYQQVPGAAPKLLMYYNGQRPSGVPDR FSGSQSGTSASLAISGLQSEDEADYYCATWD DWLGGYVFGSGTKVTVL |
| 170 | G9 VH #42 | EVQLLESGGGVVQPGRSLRLSCAASGFIFSN YGMHWVRQAPGKGLEWVAVISYDGSKQYYAD SVKGRFTISRDNSKDTLYLEMNSLRPEDTAV YYCAKVGASGDYYYSYGLDVWGQGTTVTVSS |
| 171 | G9 VL #42 | QSVLTQPPSASGTPGQTVSISCSGRNSNIGS HSVDWYQQVPGAAPKLLMYYNGHRPSGVPDR FSGSQSGTSASLAISGLQSEDEADYYCATWD DWLGGYVFGTGTKVTVL |
| 172 | G9 VH #43 | EVQLLESGGGVVQPGRSLRLSCAASGFIFGHYGMHWVRQAPGKGLEWVAVISYDGRNQYYVD SVKGRFTISRDNSKNTLYLEMNSLRPEDTAV YYCAKVGASGDYYYSYGLDVWGQGTTVTVSS |
| 173 | G9 VL #43 | QSVLTQPPSASGTPGQTVSISCSGRTSNIGR HFVDWYQQVPGAAPKLLMYYGDMRPSGVPDR FSGSQSGTSASLAISGLQSEDEADYYCATWD DSLGGYVFGSGTKVTVL |
| 174 | G9 VH #44 | EVQLLESGGGVVQPGRSLRLSCAASGFIFSN YGMHWVRQAPGKGLEWVAVISYDGTNKYYRD SVKGRFTISRDNSKNTLYLEMNSLRPEDTAV YYCAKVGALGDYYYTYGLDVWGQGTTVTVSS |
| 175 | G9 VL #44 | QSVLTQPPSASGTPGQTVSISCSGSKSNIGR HSVDWYQQVPGAAPKLLMYYSDMRPSGVPDR FSGSQSGTSASLAISGLQSEDEADYYCATWD DSLGGYVFGTGTKVTVL |
| 176 | G9 VH #45 | EVQLLESGGGVVQPGRSLRLSCAASGFIFSN YGMHWVRQAPGKGLEWVAVISYDGSRGYYAD SVKGRFTISRDNSKNTLYLEMNSLRPEDTAV YYCAKVGASGDYYYSYGLDVWGQGTTVTVSS |
| 177 | G9 VL #45 | QSVLTQPPSASGTPGQTVSISCSGSRSNIGR HCVDWYQQVPGAAPKLLIYFDDLRPSGVPDR FSGSQSGTSASLAISGLQSEDEADYYCATWD DRLAGYVFGTGTKVTVL |
| 178 | G9 VH #46 | EVQLLESGGGMVQPGRSLRLSCAASGFIFSN YGMHWVRQAPGKGLEWVAVIAYDGSRKYYAD SVKGRFTISRDNSKNTLYLEMNSLRPEDTAV YYCAKVGASGDYYYSYGLDVWGQGTTVTVSS |
| 179 | G9 VL #46 | QSVLTQPPSASGTPGQTVSISCSGSHSNIGR HSVDWYQQVPGAAPKLLMYFTDYRPSGVPDR FSGSQSGTSASLAISGLQSEDEADYYCATWD DLLAGYVFGTGTKVTVL |
| 180 | G9 VH #47 | EVQLLESGGGVVQPGRSLRLSCAASGFIFNNYGMHWVRQAPGKGLEWVAVISMDGSRKYYAD SVKGRFTISRDNSKNTLYLEMNSLRPEDTAV YYCAKVGASGDYYYSYGLDVWGQGTTVTVSS |
| 181 | G9 VL #47 | QSVLTQPPSASGTPGQTVSISCSGSPSNIGR HYVHWYQQVPGAAPKLLMYFTDQRPSGVPDR FSGSQSGTSASLAISGLQSEDETDYYCATWD DSLGGYVFGSGTKVTVL |

TABLE 21-continued

List of amino acid sequences of affinity matured G9 VH/VL variants

| SEQ ID NO: | Protein region | Sequence 12345678901234567890123456789 0 |
|---|---|---|
| 182 | G9 VH #48 | EVQLLESGGGVVQPGRSLRLSCAASGFIFTN YGMHWVRQAPGKGLEWVAVISSDGSNKYYAD SVKGRFTISRDNSKNTLYLEMNSLRPEDTAV YYCAKVGASGDYYYSYGLDVWGQGTTVTVSS |
| 183 | G9 VL #48 | QSVLTQPPSASGTPGQTVSISCSGSNSNIGS HYVDWYQQVPGAAPKLLMYYGGYRPSGVPDR FSGSQSGTSASLAISGLQSEDEADYYCATWD DSLGGYVFGTGTKVTVL |
| 184 | G9 VH #49 | EVQLLESGGGVVQPGRSLRLSCAASGFIFRD YGMHWVRQAPGKGLEWVAVISNDGWNKYYAD SVKGRFTISRDNSKNTLYLEMNSLRPEDTAV YYCAKVGASGDYYYSYGLDVWGQGTTVTVSS |
| 185 | G9 VL #49 | QSVLTQPPSASGTPGQTVSISCSGSKSNIGS HAVDWYQQVPGAAPKLLMYYGGYRPSGVPDR FSGSQSGTSASLAISGLQSEDEADYYCATWD DSLGGYVFGSGTKVTVL |
| 186 | G9 VH #50 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 187 | G9 VL #50 | QSVLTQPPSASGTPGQTVSISCSGSNSNIGG HYVDWYQQVPGAAPKLLMYYTGYRPSGVPDR FSGSQSGTSASLAISGLQSEDEADYYCATWD DSLGAYVFGTGTKVTVL |
| 188 | G9 VH #51 | EVQLLESGGGVVQPGRSLRLSCAASGFIFSN YGMHWVRQAPGKGLEWVAVISYDGSNKYYAD SVKGRFTISRDNPKNTLYLEMNSLRPEDTAV YYCAKVGASGDYYYSYGLDVWGQGTTVTVSS |
| 189 | G9 VL #51 | QSVLTQPPSASGTPGQTVSISCSGTNSNIGS HSVDWYQQVPGAAPKLLMYYTGYRPSGVPDR FSGSQSGTSASLAISGLQSEDEADYYCATWD DSLGGYVFGSGTKVTVL |
| 190 | G9 VH #52 | EVQLLESGGGVVQPGRSLRLSCAASGFIFSN YGMHWVRQAPGKGLEWVAVISSDGSNKYYSD SVKGRFTISRDNSKNTLYLEMNSLRPEDTAV YYCAKVGASGDYYYSYGLDVWGQGTTVTVSS |
| 191 | G9 VL #52 | QSVLTQPPSASRTPGQTVSISCSGNNSNIGT HYVDWYQQVPGAAPKLLMYYTGYRPSGVPDR FSGSQSGTSASLAISGLQSEDEADYYCATWD DSLGGYVFGSGTKVTVL |
| 192 | G9 VH #53 | EVQLLESGGGVVQPGRSLRLSCAASGFIFSN YGMHWVRQAPGKGLEWVAVISYDGSNKYYAD SVKGRFTISRDNSKNTLYLEMNSLRPEDTAV YYRAKVGASGDYYYSYGLDVWGQGTTVTVSS |
| 193 | G9 VL #53 | QSVLTQPPSASGTPGQTVSISCSGTNSNIGR HYVDWYQQVPGAAPKLLMYFGGYRPSGVPDR FSGSQSGTSASLAISGLQSEDEADYYCATWD DSLGGYVFGSGTKVTVL |
| 194 | G9 VH #54 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 195 | G9 VL #54 | QSVLTQPPSASGTPGQTVSISCSGSHSNIGR HPVDWYQQVPGAAPKLLMYYGGYRPSGVPDR FSGSQSGTSASLAISGLQSEDEADYYCATWD DSLGGYVFGSGTKVTVL |
| 196 | G9 VH #55 | EVQLLESGGGVVQPGRSLRLSCAASGFIFSN YGMHWVRQAPGKGMEWVAVISYDGSNKYYAD SVKGRFTISRDNSKNTLYLEMNSLRPEDTAV YYCAKVGASGDYYYSYGLDAWGQGTTVTVSS |
| 197 | G9 VL #55 | QSVLTQPPSASGTPGQTVSISCSGSHSNIGS HPVDWYQQVPGAAPKLLMYYSVYRPSGVPDR FSGSQSGTSASLAISGLQSEDEADYYCATWD DSLGGYVFGSGTKVTVL |
| 198 | G9 VH #56 | EVQLLESGGGVVQPGRSLRLSCAASGFIFSN YGMHWVRQAPGKGLEWVAVIAYDGRNKYYAD SVKGRFTISRDNSKNTLYLEMNSLRPEDTAV YYCAKVGASGDYYYSYGLDVWGQGTTVTVSS |
| 199 | G9 VL #56 | QSVLTQPPSASGTPGQTVSISCSGNHSNIGN HFVDWYQQVPGAAPKLLMYYSWYRPSGVPDR FSGSQSGTSASLAISGLQSEDEADYYCATWD DSLGGYVFGSGTKVTVL |
| 200 | G9 VH #57 | EVQLLESGGGVVQPGRSLRLSCAASGFIFSN YGMHWVRQAPGKGLEWVAVISYDGSNKYYAD SVKGRFTISRDNSKNTLYLEMNSLRPEDTAV YYCAKLGASGDYYYSYGLDVWGQGTTVTVSS |
| 201 | G9 VL #57 | QSVLTQPPSASGTPGQTVSISCSGSHSNIGR HYVDWYQQVPGAAPKLLMYYTGERPSGVPDR FSGSQSGTSASLAISGLQSEDEADYYCATWD DSLGGYVFGTGTKVTVL |
| 202 | G9 VH #58 | EVQLLESGGGVVQPGRSLRLSCAASGFIFSN YGMHWVRQAPGKGLEWVAVISSDGSNKYYAD SVKGRFTISRDNSKNTLYLEMNSLRPEDTAV YYCAKLGASGPYYYTYGLDVWGQGTTVTVSS |
| 203 | G9 VL #58 | QSVLTQPPSASGTPGQTVSISCSGSNSNIGR HTVDWYQQVPGAAPKLLMYYTGMRPSGVPDR FSGSQSGTSASLAISGLQSEDEADYYCATWD DKLGGYDFGSGTKVTVL |
| 204 | G9 VH #59 | EVQLLESGGGVVQPGRSLRLSCAASGFIFSD YGMHWVRQAPGKGLEWVAVISYDGSRKYYED SVKGRFTISRDNSKNTLYLEMNSLRPEDTAV YYCAKVGASGDYYYSYGLDVWGQGTTVTVSS |
| 205 | G9 VL #59 | QSVLTQPPSASGTPGQTVSISCSGTKSNIGR HYVDWYQQVPGAAPKLLMYWSGERPSGVPDR FSGSQSGTSASLAISGLQSEDEADYYCATWD DSLGGYVFGTGTKVTVL |
| 206 | G9 VH #60 | EVQLLESGGGVVQPGRSLRLSCAASGFIFSD YGMHWVRQAPGKGLEWVAVIAFDGSRKYYAD SVKGRFTISRDNSKNTLYLEMNSLRPEDTAV YYCAKVGASGDYYYSYGLDVWGQGTTVTVSS |
| 207 | G9 VL #60 | QSVLTQPPSASGTPGQTVSISCSGRPSNIGR HSVDWYQQVPGAAPKLLMYYFGERPSGVPDR FSGSQSGTSASLAISGLQSEDEADYYCATWD DSLGGYVFGTGTKVTVL |
| 208 | G9 VH #61 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 209 | G9 VL #61 | QSVLTQPPSASGTPGQTVSISCSGYDSNIGR HSVDWYQQVPGAAPKLLMYYYGYRPSGVPDR FSGSQSGTSASLAISGLQSEDEADYYCATWD DLLGGYVFGTGTKVTVL |

TABLE 21-continued

List of amino acid sequences of affinity matured G9 VH/VL variants

| SEQ ID NO: | Protein region | Sequence 123456789012345678901234567890 |
|---|---|---|
| 210 | G9 VH #62 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 211 | G9 VL #62 | QSVLTQPPSASGTPGQTVSISCSGTISNIGR HSVDWYQQVPGAAPKLLMYYNGHRPSGVPDR FSGSQSGTSASLAISGLQSEDEADYYCATWD DSLGGYVFGTGTKVTVL |
| 212 | G9 VH #63 | EVQLLESGGGVVQPGRSLRLSCAASGFIFSN YGMHWVRQAPGKGLEWVAVISRDGSHKYYAD SVKGRFTISRGNSKNTLYLEMNSLRPEDTAV YYCAKVGASGDYYYSYGLDVWGQGTTVTVSS |
| 213 | G9 VL #63 | QSVLTQPPSASGTPGQTVSISCSGRYSNIGR HAVDWYQQVPGAAPKLLMYYIGHRPSGVPDR FSGSQSGTSASLAISGLQSEDEADYYCATWD DSLGGYVFGSGTKVTVL |
| 214 | G9 VH #64 | EVQLLESGGGVVQPGRSLRLSCAASGFIFSN YGMHWVRQAPGKGLEWVAVISNDGHGKYYAD SVKGRFTISRDNSKNTLYLEMNSLRPEDTAV YYCAKVGASGDYYYSYGLDVWGQGTTVTVSS |
| 215 | G9 VL #64 | QSVLTQPPSASGTPGQTVSISCSGSNSNIGR HAVDWYQQVPGAAPKLLMYYIGERPSGVPDR FSGSQSGTSASLAISGLQSEDEADYYCATWD DSLGGYVFGSGTKVTVL |
| 216 | G9 VH #65 | EVQLLESGGGVVQPGRSLRLSCAASGFIFSN NGMHWVRQAPGKGLEWVAVISYDGSKKYYAD SVKGRFTISRDNSYNTLYLEMNSLRPEDTAV YYCAKVGASGDYYYSYGLDFWGQGTTVTVSS |
| 217 | G9 VL #65 | QSVLTQPPSASGTPGQTVSISCSGTTSNIGR HAVDWYQQVPGAAPKLLMYYNGWRPSGVPDR FSGSQSGTSASLAISGLQSEDEADYYCATWD DSLGGYVFGSGTKVTVL |
| 218 | G9 VH #66 | EVQLLESGGGVVQPGRSLRLSCAASGFIFSN YGMHWVRQAPGKGLEWVAVISFDGRKYYVD SVKGRFTISRDNSKNTLYLEMNSLRPEDTAV YYCAKLGASGDYYYSYGLDVWGQGTTVTVSS |
| 219 | G9 VL #66 | QSVLTQPPSASGTPGQTVSISCSGKNSNIGN HYVHWYQQVPGAAPKLLMYDFGQRPSGVPDR FSGSQSGTSASLAISGLQSEDEADYYCATWD DSLGGYVFGTGTKVTVL |
| 220 | G9 VH #67 | EVQLLESGGGVVQPGRSLRLSCAASGFIFSN YGMHWVRQAPGKGLEWVAVISSDGSKNYYVD SVKGRFTISRDNSKNTLYLEMNSLRPEDTAV YYCAKVGASGDYYYSYGLDVWGQGTTVTVSS |
| 221 | G9 VL #67 | QSVLTQPPSASGTPGQTVSISCSGTNSNIGN HFVHWYQQVPGAAPKLLMYDFSQRPSGVPDR FSGSQSGTSASLAISGLQSEDEADYYCATWD DWLVGYVFGTGTKVTVL |
| 222 | G9 VH #68 | EVQLLESGGGVVQPGRSLRLSCAASGFIFSN YGMHWVRQAQGKGLEWVAVISYDGSREYYGD SVKGRFTISRDNSKNTLYLEMNSLRPEDTAV YYCAKVGASGDYYYSYGLDVWGQGTTVTVSS |
| 223 | G9 VL #68 | QSMLTQPPSASGTPGQTVSISCSGRHSNIGS HEVHWYQQVPGAAPKLLMYDFGQRPSGVPDR FSGSQSGTSASLAISGLQSEDEADYYCATWD DWLGGYVFGTGTKVTVL |
| 224 | G9 VH #69 | EVQLLESGGGVVQPGRSLRLSCAASGFIFSD YGMHWVRQAPGKGLEWVAVISYDGCNQYYPD SVKQRFTISRDNSYNTLYLEMNSLRPEDTAV YYCAKVGASGDYYYSYGLDVWGQGTTVTVSS |
| 225 | G9 VL #69 | QSGLTQPPSASGTPGQTVSISCSGRTSNIGN HSVHWYQQVPGAAPKLLMYGFGVRPSGVPDR FSGSQSGTSASLAISGLQSEDEADYYCATWD DWLGSYVFGTGTKVTVL |
| 226 | G9 VH #70 | EVQLLESGGGVVQPGRSLRLSCAASGFIFSN GMHWVRQAPGKGLEWVAVISNDGSNKYYTD SVKGRFTISRDNSKNTLYLEMNSLRPEDTAV YYCAKVGASGDYYYSYGLDVWGQGTTVTVSS |
| 227 | G9 VL #70 | QSVLTQPPSASGTPGQTVSISCSGKNSNIGR HSVHWYQQVPGAAPKLLMYWFGTRPSGVPDR FSGSQSGTSASLAISGLQSEDEADYYCATWD DRLGGYVFGTGTKVTVL |
| 228 | G9 VH #71 | EVQLLESGGGVVQPGRSLRLSCAASGFIFSN YGMHWVRQAPGKGLEWVAVISNDGSNKYYLD SVKGRFTISRDNSKNTLYLEMNSLRPEDTAV YYCAKVGASGDYYYSYGLDVWGQGTTVTVSS |
| 229 | G9 VL #71 | QSVLTQPPSASGTPGQTVSISCSGRNSNIGY HPVHWYQQVPGAAPKLLIYDFGLRPSGVPDR FSGSQSGTSASLSISGLQSEDEADYYCATWD DWLGGYVFGTGTKVTVL |
| 230 | G9 VH #72 | EVQLLESGGGVVQPGRSLRLSCAASGFIFTN YGMHWVRQAPGKGLEWVAVISHDGCNNYYAD SVKGRFTISRDNSKNTLYLEMNSLRPEDTAV YYCAKVGASGAYYYSYGLDVWGQGTTVTVSS |
| 231 | G9 VL #72 | QSVLTQPPSASGTPGQTVSISCSGRNSNIGR HAVDWYQQVPGAAPKLLMYGIGQRPSGVPDR FSVSQSGTSASLAISGLQSEDEADYYCATWD DWLGGYVFGTGTKVTVL |
| 232 | G9 VH #73 | EVQLLESGGGVVQPGRSLRLSCAASGFIFSN YGMHWVRQAPGKGLEWVAVISYDGSNKYYGD SVKGRFTISRDNSKNTLYLEMNSLRPEDTAV YYCAKVGASGDYYYSYGLDVWGQGTTVTVSS |
| 233 | G9 VL #73 | QSVLTQPPSASGTPGQTVSISCSGTNSNIGS HAVDWYQQVPGAAPKLLMYGIDQRPSGVPDR FSVSQSGTSASLAISGLQSEDEADYYCATWD DWLAGYVFGTGTKVTVL |
| 234 | G9 VH #74 | EVQLLESGGGVVQPGRSLRLSCAASGFIFSN YGMHWVRQAPGKGLEWVAVISYDGTNKYYSD SVKGRFTISRDNSKNTLYLEMNSLRPEDTAV YYCAKVGASGDYYYSYGLDVWGQGTTVTVSS |
| 235 | G9 VL #74 | QSVLTQPPSASGTPGQTVSISCSGRNSNIGS HSVHWYQQVPGAAPKLLMYGIGERPSGVPDR FSVSQSGTSASLAISGLQSEDEADYYCATWD DWLAGYVFGTGTKVTVL |
| 236 | G9 VH #75 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 237 | G9 VL #75 | QSVLTQPPSASGTPGQTVSISCSGRNSNIGS HYVHWYQQVPGAAPKLLMYDFGLRPSGVPDR FSVSQSGTSASLAISGLQSEDEADYYCATWD DMLGGYVFGTGTKVTVL |

TABLE 21-continued

List of amino acid sequences of affinity matured G9 VH/VL variants

| SEQ ID NO: | Protein region | Sequence 123456789012345678901234567890 |
|---|---|---|
| 238 | G9 VH #76 | Same as Parental<br>EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| 239 | G9 VL #76 | QSVLTQPPTASGTPGQTVSISCSGRNSNIGNHSVHWYQQVPGAAPKLLMYDIGFRPSGVPDRFSVSQSGTSASLAISGLQSEDEADYYCATWDDWLGGYVFGTGTKVTVL |
| 240 | G9 VH #77 | EVQLLESGGGVVQPGRSLRLSCAASGFIFSNYGMHWVRQAPGKGLEWVAVISYDGSNKYYSDSVKGRFTISRDNSKNTLYLEMNSLRPEDTAVYYCAKVGASGDYYYSYGLDVWGQGTTVTVSS |
| 241 | G9 VL #77 | QSVLTQPPSASGTPGQTVSISCSGSHSNIGRHPVDWYQQVPGAAPKLLMYDFGQRPSGVPDRFSVSQSGTSASLAISGLQSEDEADYYCATWDDSLGGYVFGTGTKVTVL |
| 242 | G9 VH #78 | EVQLLESGGGVVQPGRSLRLSCAASGFIFSNYGMHWVRQAPGKGLEWVAVISCDGSNKYYADSVKGRFTISRDNSKNTLYLEMNSLRPEDTAVYYCAKVGASGDYYYSYGLDVWGQGTTVTVSS |
| 243 | G9 VL #78 | QSVLTQPPSASGTPGQTVSISCSGTNSNIGSHSVHWYQQVPGAAPKLLMYWFGERPSGVPDRFSGSPSGTSASLAISGLQSEDEADYYCATWDDSLGGYVFGSGTKVTVL |
| 244 | G9 VH #79 | EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGGSGEYYYSPGLDVWGQGTTVTVSS |
| 245 | G9 VL #79 | QSVLTQPPSASGTPGQTVSISCSGSNSNIGSRSVTWYQQVPGAAPKLLMYWFGHRPSGVPDRFSGSQSGTSASLAISGLQSEDEADYYCATWDDSLAEYVFGTGTKVTVL |
| 246 | G9 VH #80 | EVQLLESGGGVVQPGRSLRLSCAASGFIFSNYGMHWVRQAPGKGLEWVAVISYDGSKQYYADSVKGRFTISRDNSKNTLYLEMNSLRPEDTAVYYCAKVGASGDYYYSYGLDWGQGTTVTVSS |
| 247 | G9 VL #80 | QSVLTQPPSASGTPGQTVSISCSGSNSNIGYHSVHWYQQVPGAAPKLLMYYFGNRPSGVPDRFSGSQSGTSASLAISGLQSEDEADYYCATWDDSLGGYVFGTGTKVTVL |
| 248 | G9 VH #81 | EVQLLESGGGVVQPGRSLRLSCAASGFIFRNYGMHWVRQAPGKGLEWVAVISYDGSNTYYADSVKGRFTISRDNSKNTLYLEMNSLRPEDTAVYYCAKVGAYGDYYYSYGLDVWGQGTTVTVSS |
| 249 | G9 VL #81 | QSVLTQPPSASGTPGQTVSISCSGTNSNIGSHSVHWYQQVPGAAPKLLIYDFGDRPSGVPDRFSGSQSGTSASLAISGLQSEDEADYYCATWDDRLGGYVFGTGTKVTVL |
| 250 | G9 VH #82 | EVQLLESGGGVVQPGRSLRLSCAASGFIFRNYGMHWVRQAPGKGLEWVAVISYDGRRNYYADSVKGRFTISRDNSKNTLYLEMNSLRPEDTAVYYCAKLGAYGPYYYSYGLDVWGQGTMVTVSS |
| 251 | G9 VL #82 | QSVLTQPPSASGTPGQTVSISCSGGNSNIGCHSVHWYQQVPGAAPKLLMYGMGYRPSGVPDRFSGSQSGTSASLAISGLQSEDEADYYCATWDDSLGGYVFGSGTKVTVL |
| 252 | G9 VH #83 | EVQLLESGGGVVQPGRSLRLSCAASGFIFSNYGMHWVRQAPGKGLEWVAVISYDGGNTYYADSVKGRFTISRDNSKNTLYLEMNSLRPEDTAVYYCAKVGANGDYYYSYGLDVWGQGTTVTVSS |
| 253 | G9 VL #83 | QSVLTQPPSASGTPGQTVSISCSGTNSNIGNHAVNWYQQVPGAAPKLLMYGLGMRPSGVPDRFSDSQSGTSASLAISGLQSEDEADYYCATWDDSLGGYVFGTGTKVTVL |
| 254 | G9 VH #84 | Same as VH #31<br>EVQLLESGGGVVQPGRSLRLSCAASGFIFSNYGMHWVRQAPGKGLEWVAVIAYDGSNKYYADSVKGRFTISRDNSKNTLYLEMNSLRPEDTAVYYCAKVGASGDYYYSYGLDVWGQGTTVTVSS |
| 255 | G9 VL #84 | QSVLTQPPSASGTPGQTVSISCSGHNSNIGSHTVNWYQQVPGAAPKLLMYEIGYRPSGVPDRFSVSQSGTSASLAISGLQSEDEADYYCATWDDWLADYVFGTGTKVTVL |
| 256 | G9 VH #85 | EVQLLESGGGVVQPGRSLRLSCAASGFIFRNYGMHWVRQAPGKGLEWVAVIAYDGSRKYYADSVKGRFTISRDNSKNTLYLEMNSLRPEDTAVYYCAKVGASGDYYYSYGLDVWGQGTTVTVSS |
| 257 | G9 VL #85 | QSVLTQPPSASGTPGQTVSISCSGSNSNIGSHDVTWYQQVPGAAPKLLMYDMWERPSGVPDRFSVSQSGTSASLAISGLQSEDEADYYCATWDDWLGGYVFGTGTKVTVL |
| 258 | G9 VH #86 | EVQLLESGGGVVQPGRSLRLSCAASGFIFSNQGMHWVRQAPGKGLEWVAVIAYDGSKKYYADSVKGRFTISRDNSKNTLYLEMNSLRPEDTAVYYCAKVGASGDYYYSYGLDVWGQGTTVTVSS |
| 259 | G9 VL #86 | QSVLTQPPSASGTPGQTVSISCSGSNSNIGSHFVHWYQQVPGAAPKLLMYEYGWRPSGVPDRFSGSQSGTSASLAISGLQSEDEADYYCAIWDDRLVGYVFGSGTKVTVL |
| 260 | G9 VH #87 | EVQLLESGGGVVQPGRSLRLSCAASGFIFSNYGMHWVRQAPGKGLEWVAVTVISYDGSNKYYADSVKGRFTISRDNSKNTLYLEMNSLRPEDTAVYYCAKVGAYGDYYYSYGLDGWGQGTTVTVSS |
| 261 | G9 VL #87 | QSVLTQPPSASGTPGQTVSISCSGRQSNIGSHYVHWYQQVPGAAPKLLMYGIGERPSGVPDRFSGSQSGTSASLAISGLQSEDEADYYCATWDDRLVGYVFGSGTKVTVL |
| 262 | G9 VH #88 | EVQLLESGGGVVQPGRSLRLSCAASGFIFSNFGMHWVRQAPGKGLEWVAVISYDGSRKYYADSVKGRFTISRDNSKNTLYLEMNSLRPEDTAVYYCAKVGAYGDYYYSYGLDVWGQGTTVTVSS |
| 263 | G9 VL #88 | QSVLTQPPSASGTPGQTVSISCSGSNSNIGVHSVHWYQQVPGAAPKLLMYGIGQRPSGVPDRFSGSQSGTSASLAISGLQSEDEADYYCATWDDRLAGYVFGTGTKVTVL |
| 264 | G9 VH #89 | EVQLLESGGGVVQPGRSLRLSCAASGFIFSNYGMHWVRQAPGKGLEWVAVISYDGRNKYYADSVKGRFTISRDNSKNTLYLEMNSLRPEDTAVYYCAKVGASGDYYYSYGLDEWGQGTTVTVSS |
| 265 | G9 VL #89 | QSVLTQPPSASGTPGQTVSISCSGRNSNIGNHYVHWYQQVPGAAPKLLMYSIGLRPSGVPDRFSGSQSGTSASLAISGLQSEDEADYYCATWDDRLAGYVFGTGTKVTVL |
| 266 | G9 VH #90 | EVQLLESGGGVVQPGRSLRLSCAASGFIFSNYGMHWVRQAPGKGLEWVAVIAADGRKKYYAD |

TABLE 21-continued

List of amino acid sequences of affinity matured G9 VH/VL variants

| SEQ ID NO: | Protein region | Sequence 12345678901234567890123456789 0 |
|---|---|---|
| | | SVKGRFTISRDNSKNTLYLEMNSLRPEDTAV YYCAKVGAWGDYYYTYGLDSWGQGTTVTSS |
| 267 | G9 VL #90 | QSVLTQPPSASGTPGQTVSISCSGRYSNIGN HSVHWYRQVPGAAPKLLMYGIDYRPSGVPDR FSGSQSGTSASLAISGLQSEDEADYYCATWD DWLGGYVFGTGTKVTVL |
| 268 | G9 VH #91 | EVQLLESGGGVVQPGRSLRLSCAASGFIFSN YGMHWVRQAPGKGLEWVAVIGYDGYRKYYAD SVKGRFTISRDNSKNTLYLEMNSLRPEDTAV YYCAKVGASGDYYYSYGLDVWGQGTTVTSS |
| 269 | G9 VL #91 | QSVLTQPPSASRTPGQTVPISCSGRHSNIGN HSVHWYQQVPGAAPKLLMYGIGERPSGVPDR FSGSQSGTSASLAISGLQSEDEADYYCATWD DWLAGYVFGTGTKVTVL |
| 270 | G9 VH #92 | EVQLLESGGGVVQPGRSLRLSCAASGFIFSN YGMHWVRQAPGKGLEWVAVIAYDGRKKYYAD SVKGRFTISRDNSKNTLYLEMNSLRPEDTAV YYCAKVGASGDYYYSYGLDVWGQGTTVTSS |
| 271 | G9 VL #92 | QSVLTQPPSASGTPGQTVSISCSGRNSNIGN HSVHWYQQVPGAAPKLLMYGTGHRPSGVPDR FSGSQSGTSASLAISGLQSEDEADYYCASWD DGLAGYVFGSGTKVTVL |
| 272 | G9 VH #93 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 273 | G9 VL #93 | QSVLTQPPSASGTPGQTVSISCSGRKSNIGS HSVHWYQQVPGAAPKLLMYGYGERPSGVPDR FSGSQSGTSASLAISGLQSEDEADYYCAMWD DWLGGYVFGTGTKVTVL |
| 274 | G9 VH #94 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 275 | G9 VL #94 | QSVLTQPPSASGTPGQTVSISCSGSISNIGS HSVHWYQQVPGAAPKLLMYGLGYRPSGVPDR FSVSQSGTSASLAISGLQSEDEADYYCATWD DSLGGYVFGTGTKVTVL |
| 276 | G9 VH #95 | EVQLLESGGGVVQPGRSLRLSCAASGFIFNN NGMHWVRQAPGKGLEWVAVISKDGRNKYYGD SVKGRFTISRDNSKNTLYLEMNSLRPEDTAV YYCAKVGAYGDYYYSYGLDVWGQGTTVTSS |
| 277 | G9 VL #95 | QSVLTQPPSASGTPGQTVSISCSGSKSNIGS HYVHWYQQVPGAAPKLLMYGICQRPSGVPDR FSGSQSGTSASLAISGLQSEDEADYYCATWD DSLGGYVFGTGTKVTVL |
| 278 | G9 VH #96 | EVQLLESGGGVVQPGRSLRLSCAASGFIFSN YGMHWVRQAPGKGLEWVAVISRDGRRKYYSD SVKGRFTISRDNSKNTLYLEMNSLRPEDTAV YYCAKVGALGDYYYSYGLDVWGQGTTVTSS |
| 279 | G9 VL #96 | QSVLTQPPSASGTPGQTVSISCSGSNSNIGR HYVHWYQQVPGAAPKLLMYGIGQRPSGVPDR FSGSQSGTSASLAISGLQSEDEADYYCATWD DSLGGYVFGSGTKVTVL |
| 280 | G9 VH #97 | EVQLLESGGGVVQPGRSLRLSCAASGFIFSN YGMHWVRQAPGKGLEWVAVISNDGTNKYYTD SVKGRFTISRDNSKNTLYLEMNSLRPEDTAV YYCAKVGASGDYYYSYGLDVWGQGTTVTSS |
| 281 | G9 VL #97 | QSVLTQPPSASGTPGQTVSISCSGSKSNIGR HFVHWYQQVPGAAPKLLMYANGQRPSGVPDR FSGSQSGTSASLAISGLQSEDEADYYCATWD DSLGGYVFGSGTKVTVL |
| 282 | G9 VH #98 | EVQLLESGGGVVQPGRSLRLSCAASGFIFRN NGMHWVRQAPGKGLEWVAVISYDGRNKYYED SVKGRFTISRDNSKNTLYLEMNSLRPEDTAV YYCAKVGASGDYYYSFGLDVWGQGTTVTSS |
| 283 | G9 VL #98 | QSVLTQPPSASGTPGQTVSISCSGSISNIGR HAVHWYQQVPGAAPKLLMYYFGERPSGVPDR FSGSQSGTSASLAISGLQSEDEADYYCATWD DSLGGYVFGSGTKVTVL |
| 284 | G9 VH #99 | EVQLLESGGGVVQPGRSLRLSCAASGFIFSN YGMHWVRQAPGKGLEWVAVISYDGSNKYYAD SVKGRFTISRDNSKNTLYLEMNSLRPEHTAV YYCAKVGASGDYYYSYGLDVWGQGTTVTSS |
| 285 | G9 VL #99 | QSVLTQPPSASGTPGQTVSISCSGRNSNIGR HHVHWYQQVPGAAPKLLMYGIGYRPSGIPDR FSGSQSGTSASLAISGLQSEDEADYYCATWD DSLGAYVFGSGTKVTVL |
| 286 | G9 VH #100 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 287 | G9 VL #100 | QSVLTQPPSASGTPGQTVSISCSGNRSNIGH HSVHWYQQVPGAAPKLLMYGISERPSGVPDR FSGSQSGTSASLAISGLQSEDEADYYCATWD DSLGGYVFGSGTKVTVL |
| 288 | G9 VH #101 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 289 | G9 VL #101 | QSVLTQPPSASGTPGQTVSISCSGITSNIGR HSVHWYQQVPGAAPKLLMYGICQRPSGVPDR FSGSQSGTSASLAISGLQSEDEADYYCATWD DSLGGYVFGSGTKVTVL |
| 290 | G9 VH #102 | EVQLLESGGGVVQPGRSLRLSCAASGFIFSN YGMHWVRQAPGKGLEWVAVISYDGANRYYSD SVKGRFTISRDNSKNTLYLEMNSLRPEDTAV YYCAKVGASGDYYYSYGLDVWGQGTTVTSS |
| 291 | G9 VL #102 | QSVLTQPPSASGTPGQTVSISCSGRNSNIGR HSVHWYQQVPGAAPKLLMYWYGQRPSGVPDR FSGSQSGTSASLAISGLQSEDEADYYCATWD DSLGGYVFGSGTKVTVL |
| 292 | G9 VH #103 | EVQLLESGGGVVQPGRSLRLSCAASGFIFSN YGMHWVRQAPGKGLEWVAVISYDGSNTYYAD SVKGRFTISRDNSKNTLYLEMNSLRPEDTAV YYCAKVGASGDYYYSYGLDVWGQGTTVTSS |
| 293 | G9 VL #103 | QSVLTQPPSASGTPGQTVSISCSGYNSNIGR HYVHWYQQVPGAAPKLLMYSNGLRPSGVPDR FSGSQSGTSASLAISGLQSEDEADYYCATWD DSLGGYVFGSGTKVTVL |

TABLE 21-continued

List of amino acid sequences of affinity matured G9 VH/VL variants

| SEQ ID NO: | Protein region | Sequence 12345678901234567890123456789 |
|---|---|---|
| 294 | G9 VH #104 | EVQLLESGGGVVQPGRSLRLSCAASGFIFSNYGMHWVRQAPGKGLEWVAVISYDGSNKYYVD SVKGRFTISRDNSKNTLYLEMNSLRPEDTAV YYCAKVGASGDYYYSYGLDVWGHGTTVTVSS |
| 295 | G9 VL #104 | QSVLTQPPSASGTPGQTVSISCSGINSNIGR HYVNWYQQVPGAAPKLLIYADGWRPSGVPDR FSGSQSGTSASLAISGLQSEDEADYYCATWD DSLGAYVFGSGTKVTVL |
| 296 | G9 VH #105 | EVQLLESGGGVVQPGRSLRLSCAASGFIFSNYGMHWVRQAPGKGLEWVAVISYDGGNQYYVD SVKGRFTISRDNSKNTLYLEMNSLARPEDTAV YYCAKVGASGDYYYSYGLDVWGQTTVTVSS |
| 297 | G9 VL #105 | QSVLTQPPSASGTPGQTVSISCSGSNSNIGR HYVHWYQQVPGAAPKLLMYFNGVRPSGVPDR FSGSQSGTSASLTISGLQSEDEADYYCATWD DWLADYVFGSGTKVTVL |
| 298 | G9 VH #106 | EVQLLESGGGVVQPGRSLRLSCAASGFIFSNYGMHWVRQAPGKGLEWVAVISYDGHNQYYQD SVKGRFTISRDNSKNTLYLEMNSLRPEDTAV YYCAKVGASGDYYYSYGLDVWGQTTVTVSS |
| 299 | G9 VL #106 | QSVLTQPPSASGTPGQTVSISCSGANSNIGR HYVHWYQQVPGAAPKLLIYDGMRPSGVPDR FSGSQSGTSASLAISGPQSEDEADYYCATWD DRLVGYVFGTGTKVTVL |
| 300 | G9 VB #107 | EVQLLESGGGVVQPGRSLRLSCAASGFIFRNYGMHWVRQAPGKGLEWVAVISHDGSNKYYAD SVKGRFTISRDNSKNTLYLEMNSLRPEDTAV YYCAKVGASGDYYYSYGLDVWGQTTVTVSS |
| 301 | G9 VL #107 | QSVLTQPPSASGTPGQTVSISCSGINSNIGY HYVHWYQQVPGAGPKLLIYGSSERPSGVPDR FSGSQSGTSASLAISGLQSEDEADYYCATWD DSLVGYVFGTGTKVTVL |
| 302 | G9 VH #108 | Same as Parental EVQLLESGGGVVQPGRSLRLSCAASGFIFSNYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 303 | G9 VL #108 | QSVLTQPPSASGTPGQTVSISCSGHNSNIGY HYVHWYQQVPGAAPKLLIYGDGWRPSGVPDR FSGSQSGTSASLAISGLQSEDEADYYCGTWD DWLGGYVFGTGTKVTVL |
| 304 | G9 VH #109 | EVQLLESGGGVVQPGRSLRLSCAASGFIFSNYGMHWVHQAPGKGLEWVAVISHDGSKQYYAD SLKGRFTISRDNSKNTLYLEMNSLRPEDTAV YYCAKLGASGDYYYSYGLDYWGQTTVTVSS |
| 305 | G9 VL #109 | QSVLTQPPSASGTPGQTVSISCSGHNSNIGY HYVHWYQQVPGAAPKLLIYGDGWRPSGVPDR FSGSQSGTSASLAISGLQSEDEADYYCATWD DSLGGYVFGSGTKVTVL |
| 306 | G9 VH #110 | EVQLLESGGGVVQPGRSLRLSCAASGFIFGNYGMHWVRQAPGKGLEWVAVISYDGSNKYYGD SVKGRFTISRDNSKNTLYLEMNSLRPEDTAV YYCAKVGAYGDYYYSYGLDVWGQTTVTVSS |
| 307 | G9 VL #110 | QSVLTQPPSASGTPGQTVSISCSGRQSNIGR HSVDWYQQVPGAAPKLIIYGIGQRPSGVPDR FSGSQSGTSASLTISGLQSEDEADYYCATWD DSLGGYVFGTGTKVTVL |
| 308 | G9 VH #111 | EVQLLESGGGVVQPGRSLRLSCAASGFIFSNYGMHWVRQAPGKGLEWVAVISYDGSNKYYAD SVKGRFTISRDNSKNTLYLEMNSLRPEDTAV YYCAKVGAYGDYYYSYGLDFWGQGTTVTVSS |
| 309 | G9 VL #111 | QSVLTQPPSASGTPGQTVSISCSGSNSNIGR HYVHWYQQVPGAAPKLLIYGVGQRPSGVPDR FSGSQSGTSASLAISGLQSEDEADYYCATWD DSLAGGYVFGSGTKVTVL |
| 310 | G9 VH #112 | EVQLLESGGGVVQPGSSLRLSCAASGFIFSNYGMHWVRQAPGKGLEWVAVISYDGSNKYYAD SVKGRFTISRDNSKNSLYLEMNSLRPEDTAV YYCAKVGASGDYYYSYGLDVWGQTTVTVSS |
| 311 | G9 VL #112 | QSVLTQPPSASGTPGQTASISCSGSNSNIGR HYVDWYQQVPGAAPKLLIYGGGQRPSGVPDR FSGSQSGTSASLAISGLQSEDEADYYCATWD DSLGGYVFGSGTKVTVL |
| 312 | G9 VH #113 | EVQLLESGGGVVQPGRSLRLSCAASGFIFTNYGMHWVRQAPGKGLEWVAVISHDGSNKYYAD SVKGRFTIPRDNSKNTLYLEMNSLRPEDTAV YYCAKVGASGDYYYSYGLDVWGQTTVTVSS |
| 313 | G9 VL #113 | QSVLTQPPSASGTPGQTVSISCSGRNSNIGR HSVHWYQQVPGAAPKLLIYDVGQRPSGVPDR FSGSQSGTSASLAISGLQSEDEADYYCATWD DWLAGYVFGSGTKVTVL |
| 314 | G9 VH #114 | EVQLLESGGGVVQPGRSLRLSCAASGFIFRNYGMHWVRQAPGKGLEWVAVISYDGSNKYYAD SVKGRFTISRDNSKNTLYLEMNSLKPEDTAV YYCAKVGASGDYYYSYGLDVWGQTTVTVSS |
| 315 | G9 VL #114 | QSVLTQPPSASGTPGQTVSISCSGSNSNIGR HSVHWYQQVPGAAPKLLIYDGQRPSGVPDR FSGSQSGTSASLAISGLQSEDEADYYCATWD DRLGGYVFGSGTKVTVL |
| 316 | G9 VH #115 | EVQLLESGGGVVQPGRSLRLSCAASGFIFSNYGMHWVRQAPGKGLEWVAVISYDGSNKYYAD SVKGRFTISRDNSKNTLYLEMNSLRPEDTAV YYCAKVGAFGDYYYSYGLDVWGQTTVTVSS |
| 317 | G9 VL #115 | QSVLTQPPSASGTPGQTVSISCSGNKSNIGR HYVHWYQQVPGAAPKLLMYYDGQRPSGVPDR FSGSQSGTSASLAISGLQSEDEADYYCGTWD DRLGGYVFGTGTKVTVL |
| 318 | G9 VH #116 | EVQLLESGGGVVQPGRSLRLSCAASGFLFSNYGMHWVRQAPGKGLEWVAVISYDGSNKYYAD SVKGRFTISRDNSKNTLYLEMNSLRPEDTAV YYCAKVGAFGDYYYSYGLDVWGQTTVTVSS |
| 319 | G9 VL #116 | QSVLTQPPSASGTPGQTVSISCSGSNSNIGM HYVHWYQQVPGAAPKLLMYYSGLRPSGVPDR FSGSQSGTSASLAISGLQSEDEADYYCATWD DSLGGYVFGTGTKVTVL |
| 320 | G9 VH #117 | EVQLLESGGGVVQPGRSPRLSCAASGFIFSNYGMHWVRQAPGKGLEWVAVISYDGSNKYYAD SVKGRFTISRDNSKNTLYLEMNSLRPEDTAV YYCAKVGASGDYYYSYGLDVWGQTTVTVSS |
| 321 | G9 VL #117 | QSVLTQPPSASGTPGQTVSISCSGSRSNIGR HYVHWYQQVPGAAPKLLMYDFYRPSGVPDR FSGSQSGTSASLAISGLQSEDEADYYCATWD DSLGGYVFGTGTKVTVL |
| 322 | G9 VH #118 | Same as VH #73 EVQLLESGGGVVQPGRSLRLSCAASGFIFSNYGMHWVRQAPGKGLEWVA**VISYDGSNKYYGD |

TABLE 21-continued

List of amino acid sequences of affinity matured G9 VH/VL variants

| SEQ ID NO: | Protein region | Sequence 12345678901234567890123456789 0 |
|---|---|---|
| | | SVKGRFTISRDNSKNTLYLEMNSLRPEDTAV YYCAKVGASGDYYYSYGLDVWGQGTTVTSS |
| 323 | G9 VL #118 | QSVLTQPPSASGTPGQTVSISCSGSNSNIGN HYVHWYQQVPGAAPKLLIYDFGYRPSGVPDR FSVSQSGTSASLAISGLQSEDEADYYCATWD DSLGGYVFGSGTKVTVL |
| 324 | G9 VH #119 | EVQLLESGGGVVQPGRSLRLSCAASGFIFSN YGMHWVRQAPGKGLEWVAVISHDGWSKYYAD SVKGRFTISRDNSKNTLYLEMNSLRPEDTAV YYCAKVGASGDYYYSYGLDAWGQGTTVTSS |
| 325 | G9 VL #119 | QSVLTQPPSASGTPGQTVSISCSGNYSNIGT HYVHWYQQVPGAAPKLLIYDFGHRPSGVPDR FSVSQSGTSASLAISGLQSEDEADYYCATWD DRLAGYVFGSGTKVTVL |
| 326 | G9 VH #120 | EVQLLESGGGVVQPGRSLRLSCAASGFIFSN YGMHWVRQAPGKGLEWVAVISYDGSNKYYAD SVKGRFTISRDNSKNTLYLEMNSLRPEDTAV YYCAKVGASGDYYYSYGLDLWGQGTTVTSS |
| 327 | G9 VL #120 | QSVLTQPPSASGTPGQTVSISCSGSYSNIGS HYVHWYQQVPGAAPKLLMYDFGERPSGVPDR FSGSQSGTSASLAISGLQSEDEADYYCATWD DSLGGYVFGSGTKVTVL |
| 328 | G9 VH #121 | EVQLLESGGGVVQPGRSLRLSCAASGFIFSN YGMHWVRQAPGKGLEWVAVISYDGGNAYYAD SVKGRFTISRDNSENTLYLEMNSLRPEDTAV YYCAKLGASGDYYYSYGLDVWGQGTTVTSS |
| 329 | G9 VL #121 | QSVLTQPPSASGTPGQTVSISCSGSNSNIGS HYVHWYQQVPGAAPKLLIYWGGLRPSGVPDR FSGSQSGTSASLAISGLQSEDEADYYCALWD DRLGGYVFGTGTKVTVL |
| 330 | G9 VH #122 | EVQLLESGGGVVQPGRSLRLSCAASGFIFSN YGMHWVRQAPGKGLEWVAVISYDGGYKYYAD SVKGRFTISRDNSKNTLYLEMNSLRPEDTAV YYCAKLSLSGDYYYSYGFDGWGQGTTVTSS |
| 331 | G9 VL #122 | QSVLTQPPSASGTPGQTVSISCSGSKSNIGS HYVHWYQQVPGAAPKLLMYDFGQRPSGVPDR FSGSQSGTSASLAISGLQSEDEADYYCGTWD DWLGGYVFGTGTKVTVL |
| 332 | G9 VH #123 | EVQLLESGGGVVQPGRSLRLSCAASGFIFSN YGMHWVRQAPGKGLEWVAVISYDGRNKYYAD SVKGRFTISRDNSKNTLYLEMNSLRPEDTAV YYCAKVGAKGDYYYSYGLDLWGQGTTVTSS |
| 333 | G9 VL #123 | QSVLTQPPSASGTPGQTVSISCSGNRSNIGS HYVHWYQQVPGAAPKLLIYSMGQRPSGVPDR FSGSQSGTSASLAISGLQSEDEADYYCATWD DSLGGYVFGTGTKVTVL |
| 334 | G9 VH #124 | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 335 | G9 VL #124 | QSVLTQPPSASGTPGQTVSISCSGSHSNIGR HPVDWYQQVPGAAPKLLMYYGGYRPSGVPDR FSGSQSGTSASLAISGLQSEDEADYYCATWD DRLVGYVFGSGTKVTVL |
| 336 | G9 VH #125 | Same as VH #14 EVQLLESGGGVVQPGRSLRLASCAASGFIFRN YGMHWVRQAPGKGLEWVAVISYDGSNKYYAD SVKGRFTISRDNSKNTLYLEMNSLRPEDTAV YYCAKVGASGDYYYSYGLDVWGQGTTVTSS |
| 337 | G9 VL #125 | Same as VL #26 QSVLTQPPSASGTPGQTVSISCSGSNSNIGR HPVDWYQQVPGAAPKLLIYYDDQRPSGVPDR FSGSQSGTSASLAISGLQSEDEADYYCATWD DSLGGYVFGSGTKVTVL |

The sequences of the individual CDRs of the VH and VL regions of the affinity matured fully human IL-17 antibodies from IL17-TN-L7-G9 in the above table can be aligned to provide consensus CDR sequences such as those in the table below.

TABLE 22

| CDR region | Sequence Identifier | Consensus Sequence |  |  |  |  |  |  |  |  |  |  |  |  |  |  |  |
|---|---|---|---|---|---|---|---|---|---|---|---|---|---|---|---|---|---|
| | | $X_1$ | $X_2$ | $X_3$ | $X_4$ | $X_5$ | $X_6$ | $X_7$ | $X_8$ | $X_9$ | $X_{10}$ | $X_{11}$ | $X_{12}$ | $X_{13}$ | $X_{14}$ | $X_{15}$ | $X_{16}$ | $X_{17}$ |
| CDR-H1 | SEQ ID NO.: 338 | N D Y H | Y N H Q F | G | M | H | | | | | | | | | | | | |
| CDR-H2 | SEQ ID NO.: 339 | V | I | S A G S H R F C M K A | Y N S | D | G | S R T G W H C Y | N R K S H G A | K Q T R N G Y S E | Y | Y | A S V G T E P R Q L | D | S | V L | K | G |
| CDR-H3 | SEQ ID NO.: 340 | V L | G S | A L G | S Y L | G | D P N | Y | Y | S | Y T P F | G | L F P F | D | V L Y |  |  |  |

TABLE 22-continued

| CDR region | Sequence Identifier | Consensus Sequence | | | | | | | | | | | | | | | |
|---|---|---|---|---|---|---|---|---|---|---|---|---|---|---|---|---|---|
| | | $X_1$ | $X_2$ | $X_3$ | $X_4$ | $X_5$ | $X_6$ | $X_7$ | $X_8$ | $X_9$ | $X_{10}$ | $X_{11}$ | $X_{12}$ | $X_{13}$ | $X_{14}$ | $X_{15}$ | $X_{16}$ | $X_{17}$ |
| | | | | | F | | E | | | | | | | | | | | G |
| | | | | | W | | A | | | | | | | | | | | F |
| | | | | | N | | | | | | | | | | | | | A |
| | | | | | K | | | | | | | | | | | | | S |
| | | | | | | | | | | | | | | | | | | E |
| CDR-L1 | SEQ ID NO.: 341 | S | G | R | N | S | N | I | G | R | H | Y | V | D | | | | |
| | | | | S | Q | | | | | S | R | S | | H | | | | |
| | | | | T | K | | | | | N | | P | | N | | | | |
| | | | | N | H | | | | | Y | | A | | T | | | | |
| | | | | H | R | | | | | T | | F | | Y | | | | |
| | | | | I | Y | | | | | C | | T | | | | | | |
| | | | | Y | T | | | | | V | | H | | | | | | |
| | | | | K | I | | | | | M | | E | | | | | | |
| | | | | G | P | | | | | H | | D | | | | | | |
| | | | | A | S | | | | | G | | C | | | | | | |
| | | | | | M | | | | | | | | | | | | | |
| | | | | | D | | | | | | | | | | | | | |
| CDR-L2 | SEQ ID NO.: 342 | Y | D | G | Q | R | P | S | | | | | | | | | | |
| | | G | I | S | I | | | | | | | | | | | | | |
| | | D | F | D | Y | | | | | | | | | | | | | |
| | | W | T | V | E | | | | | | | | | | | | | |
| | | F | S | W | L | | | | | | | | | | | | | |
| | | S | N | C | H | | | | | | | | | | | | | |
| | | E | G | F | W | | | | | | | | | | | | | |
| | | A | Y | | M | | | | | | | | | | | | | |
| | | | V | | V | | | | | | | | | | | | | |
| | | | M | | T | | | | | | | | | | | | | |
| | | | L | | S | | | | | | | | | | | | | |
| | | | | | N | | | | | | | | | | | | | |
| | | | | | F | | | | | | | | | | | | | |
| | | | | | D | | | | | | | | | | | | | |
| CDR-L3 | SEQ ID NO.: 343 | A | T | W | D | D | S | L | G | G | Y | V | | | | | | |
| | | G | S | | | | W | | A | A | | D | | | | | | |
| | | | M | | | | R | | V | E | | | | | | | | |
| | | | L | | | | M | | | D | | | | | | | | |
| | | | I | | | | L | | | V | | | | | | | | |
| | | | | | | | K | | | S | | | | | | | | |
| | | | | | | | H | | | | | | | | | | | |
| | | | | | | | G | | | | | | | | | | | |
| | | | | | | | F | | | | | | | | | | | |

The sequence data for CDR-H1 of the VH regions of the affinity matured fully human IL-17 antibodies from IL17-TN-L7-G9 also revealed that the first amino acid ($X_1$ position) of CDR-H1 is preferably preceded by an amino acid selected from S, R, N, T, G, and P.

Considering the aligned CDRs from affinity matured human IL-17 antibodies (Table 22) and from the isolated fully human IL-17 antibodies (Table 6) leads to a more comprehensive set of consensus CDR sequences. See, Summary of Invention, supra.

The following were converted into IgG for further characterization.

TABLE 23

| SEQ ID No: | Protein region | Sequence 12345678901234567890123456789012345678901234567890 |
|---|---|---|
| 344 | G9-1VH | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 345 | G9-1VL | QSVLTQPPSASGTPGQTVSISCSGSHSNIGR HPVDWYQQVPGAAPKLLMYYGGYRPSGVPDR FSGSQSGTSASLAISGLQSEDEADYYCATWD DRLVGYVFGSGTKVTVLG |
| 346 | G9-3VH | Same as Parental EVQLLESGGGVVQPGRSLRLSCAASGFIFS NYGMHWVRQAPGKGLEWVAVISYDGSNKYY ADSVKGRFTISRDNSKNTLYLEMNSLRPED TAVYYCAKVGASGDYYYSYGLDVWGQGTTV TVSS |
| 347 | G9-3VL | QSVLTQPPSASGTPGQTVSISCSGRNSNIGS HYVHWYQQVPGAAPKLLMYDFGLRPSGVPDR FSVSQSGTSASLAISGLQSEDEADYYCATWD DMLGGYVFGTGTKVTVLG |
| 348 | G9-4VL | QSVLTQPPSASGTPGQTVSISCSGRQSNIGR HYVDWYQQVPGAAPKLLMYYDSIRPSGVPDR FSGSQSGTSASLAISGLQSEDEADYYCATWD DSLGGYVFGSGTKVTVLG |

TABLE 23-continued

| SEQ ID No: | Protein region | Sequence 123456789012345678901234567890 |
|---|---|---|
| 349 | G9-M3VH | Same as Parental<br>EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| 350 | G9-M2VL | QSVLTQPPSASGTPGQTVSISCSGHNSNIGY HYVHWYQQVPGAAPKLLIYGDGWRPSGVPDRFSGSQSGTSASLAISGLQSEDEADYYCGTWD DWLGGYVFGTGTKVTVLG |

G9-1,3,4 and M2 have an identical VH sequence as the parental IL17-TN-L7-G9

| 351 | G9-2VH | EVQLLESGGGVVQPGRSLRLSCAASGFIFRN YGMHWVRQAPGKGLEWVAVISYDGSNKYYAD SVKGRFTISRDNSKNTLYLEMNSLRPEDTAVYYCAKVGASGDYYYSYGLDVWGQGTTVTVSS |
| 352 | G9-2VL | QSVLTQPPSASGTPGQTVSISCSGSNSNIGR HPVDWYQQVPGAAPKLLIYYDDQRPSGVPDRFSGSQSGTSASLAISGLQSEDEADYYCATWD DSLGGYVFGSGTKVTVLG |
| 353 | G9-5VH | EVQLLESGGGVVQPGRSLRLSCAASGFIFRN YGMHWVRQAPGKGLEWVAVIAYDGSRQYYSD SVKGRFTISRDNSKNTLYLEMNSLRPEDTAVYYCAKVGASGDYYYSYGLDLWGQGTTVTVSS |
| 354 | G9-5VL | QSVLTQPPSASGTPGQTVSISCSGRQSNIGR HYVDWYQQVPGAAPKLLMYYDSIRPSGVPDRFSGSQSGTSASLAISGLQSEDEADYYCGMWD DSLAGYVFGSGTKVTVLG |
| 355 | G9-6VH | EVQLLESGGGVVQPGRSLRLSCAASGFIFSD YGMHWVRQAPGKGLEWVAVISYDGSNKYYAD SVKGRFTISRDNSKNTLYLEMNSLRPEDTAVYYCAKVGASGDYYYSYGLDVWGQGTTVTVSS |
| 356 | G9-6VL | QSVLTQPPSASGTPGQTVSISCSGRQSNIGN HYVDWYQQVPGAAPKLLIYGDVIRPSGVPDRFSGSQSGTSASLAISGLQSEDEADYYCATWD DWLAGYVFGSGTKVTVLG |
| 357 | G9-M1VH | EVQLLESGGGVVQPGRSLRLSCAASGFIFSN YGMHWVRQAPGKGLEWVAVISYDGGYKYYAD SVKGRFTISRDNSKNTLYLEMNSLRPEDTAVYYCAKLSLSGDYYYSYGFDWGQGTTVTVSS |
| 358 | G9-M1VL | QSVLTQPPSASGTPGQTVSISCSGSKSNIGS HYVHWYQQVPGAAPKLLMYDFGQRPSGVPDRFSGSQSGTSASLAISGLQSEDEADYYCGTWD DWLGGYVFGTGTKVTVLG |

Similarly, affinity maturation selection methods were also employed to generate affinity matured fully human IL-17 antibodies from IL-17-TN-K7-B6. (The amino acid sequences of the VH and VL regions of the fully human IL-17-TN-K7-B6 antibody are shown in Table 6 above.) One light chain library is constructed to contain limited mutagenesis at the following residues: CDRL1: 28, 30, 31, 32; CDRL2: 50, 53, 55; CDRL3: 91, 92, 93, 96, 97 (Kabat numbering). This library also contains V2I, M4L, and L104V framework germline back-mutations as well as binary diversities at position 77 (S/G), 84(G/A), and 100(P/Q) to allow for framework germ-lining during library selections. Two heavy chain libraries are made to contain limited mutagenesis in CDRH1 and CDRH2 at residues 30, 31, 33, 34, 35, 52a, 53, 54, 55, 56, 57, and 58 (Kabat numbering) or in CDRH3 at residues 95-100, 100a-100i, and 102. The heavy chain libraries also contain a P108T framework germline back-mutation in addition to binary diversities at residues 16(S/E), 18(V/L), 20(V/I), and 73(K/E) to allow for framework germ-lining during library selections. All three libraries are selected separately by decreasing concentrations of human IL-17, cyno IL-17, or human IL-17A/F. All mutated CDR sequences are then recombined into one library and the recombined library is subjected to more stringent selection conditions before individual antibodies are identified.

The table below provides a list of amino acid sequences of VH regions of affinity matured fully human IL-17 antibodies derived from IL-17-TN-K7-B6 Amino acid residues of individual CDRs of each VH sequence are indicated in bold.

TABLE 24

List of amino acid sequences of affinity matured B6 VH variants

| Clone | SEQ ID NO: | VH |
|---|---|---|
| J313M2S3#11 | 359 | EVQLVQSGAEVKKPGESLKISCKASGGSFRSYGISWVRQAPGQGLEWMGGITTFFGITDYAQKFQGRVTITADESTTTAYMELSGLTSDDTAVYYCARDPNEFWNGYYATHDFDYWGQGTTVTVSS |
| J313M2S3#45 | 360 | EVQLVQSGAEVKKPGESLKISCKASGGSFRSYGISWVRQAPGQGLEWMGGITNFFGWTDYAQKFQGRVTITADESTTTAYMELSGLTSDDTAVYYCARDPNEFWNGYYATHDFDYWGQGTTVTVSS |
| J313M2S3#61 | 361 | EVQLVQSGAEVKKPGESLKISCKASGGSFRSYGISWVRQAPGQGLEWMGGITNFFGAVDYAQKFQGRVTITADESTTTAYMELSGLTSDDTAVYYCARDPNEFWNGYYATHDFDYWGQGTTVTVSS |
| J313M2S3#14 | 362 | EVQLVQSGAEVKKPGESLKISCKASGGSFVSYGICWVRQAPGQGLEWMGGITNFFGTTDYAQKFQGRVTITADESTTTAYMELSGLTSDDTAVYYCARDPNEFWNGYYATHDFDYWGQGTTVTVSS |

TABLE 24-continued

List of amino acid sequences of
affinity matured B6 VH variants

| Clone | SEQ ID NO: | VH |
|---|---|---|
| J313M2S3#26 | 363 | EVQLVQSGAEVKKPGESLKISCKASGGSFSSYGIVWVRQA PGQGLEWMGGITTFFGATDYAQKFQGRVTITADESTTTAY MELSGLTSDDTAVYYCARDPNEFWNGYYATHDFDYWGQGT TVTVSS |
| J313M2S3#86 | 364 | EVQLVQSGAEVKKPGESLKISCKASGGSFSSYGIVWVRQA PGQGLEWMGGITTFFGATDYAQKFQGRVTITADESTTTAY MELSGLTSDDTAVYYCARDPNEFWNGYYATHDFDIWGQGT TVTVSS |
| J313M2S3#82 | 365 | EVQLVQSGAEVKKPGESLKISCKASGGSFSSYGIVWVRQA PGQGLEWMGGITTFFGATDYAQKFQGRVTITADESTTTAY MELSGLTSDDTAVYYCARDPNEFWNGYYDTHDFDSWGQGT TVTVSS |
| J313M2S3#59 | 366 | EVQLVQSGAEVKKPGESLKVSCKASGGSFKSYGISWVRQA PGQGLEWMGGITIFFGTVDYAQKFQGRVTITADESTTTAY MELSGLTSDDTAVYYCARDPNEFWNGYYNTHDFDYWGQGT TVTVSS |
| J313M2S3#90 | 367 | EVQLVQSGAEVKKPGESLKISCKASGGSFRSYGISWVRQA PGQGLEWMGGITHFFGTVDYAQKFQGRVTITADESTTTAY MELSGLTSDDTAVYYCARDPNEFWNGYYDTHDLDYWGQGT TVTVSS |
| J313M2S3#16 | 368 | EVQLVQSGAEVKMPGSSLKISCKASGGSFRGYGISWVRQA PGQGLEWMGGITPFFGWADYAQKFQGRVTITADESTTTAY MELSGLTSDDTAVYYCARDPNEFWNGYYDTHHFDYWGQGT TVTVSS |
| J313M2S3#24 | 369 | EVQLVQSGAEVKMPGSSLKISCKASGGSFRGYGISWVRQA PGQGLEWMGGITPFFGWADYAQKFQGRVTITADESTTTAY MELSGLTSDDTAVYYCARDPNEFWNGYYDTHDFDSWGQGT TVTVSS |
| J313M2S3#42 | 370 | EVQLVQSGAEVKKPGESLKISCKASGGSFKGYGISWVRQA PGQGLEWMGGITPFFGWTDYAQKFQGRVTITADESTTTAY MELSGLTSDDTAVYYCARDPNEFWNGYYATHDFDYWGQGT TVTVSS |
| J313M2S3#78 | 371 | EVQLVQSGAEVKKPGESLKISCKASGGSFKGYGISWVRQA PGQGLEWMGGITPFFGWTDYAQKFQGRVTITADESTTTAY MELSGLTSDDTAVYYCARDPNEFWNGYYDTHHFDYWGQGT TVTVSS |
| J313M2S3#18 | 372 | EVQLVQSGAEVKKPGESLKVSCKASGGRFRTYGISWVRQA PGQGLEWMGGITNFFGWTDYAQKFQGRVTITADESTTTAY MELSGLTSDDTAVYYCARVPNEFWNGYYATDYFDNWGQGT TVTVSS |
| J313M2S3#30 | 373 | EVQLVQSGAEVKKPGESLKVSCKASGGRFRTYGISWVRQA PGQGLEWMGGITNFFGWTDYAQKFQGRVTITADESTTTAY MELSGLTSDDTAVYYCAREPNEFWNGYYTTHDFDSWGQGT TVTVSS |
| J313M2S3#12 | 374 | EVQLVQSGAEVKKPGESLKISCKASGGSFISYGISWVRQA PGQGLEWMGGITHFFGSTDYAQKFQGRVTITADESTTTAY MELSGLTSDDTAVYYCARDPNEFWNGYYATHDFDYWGQGT TVTVSS |
| J313M2S3#13 | 375 | EVQLVQSGAEVKKPGESLKISCKASGGSFISYGISWVRQA PGQGLEWMGGITHFFGSTDYAQKFQGRVTITADESTTTAY MELSGLTSDDTAVYYCARVPNEFWNGYYATQDFDYWGQGT TVTVSS |
| J313M2S3# 2 | 376 | EVQLVQSGAEVKKPGESLKISCKASGGSFISYGISWVRQA PGQGLEWMGGITHFFGSTDYAQKFQGRVTITADESTTTAY MELSGLTSDDTAVYYCARVPNEFWNGYYATDYFDYWGQGT TVTVSS |
| J313M2S3#46 | 377 | EVQLVQSGAEVKKPGESLKISCKASGGSFISYGISWVRQA PGQGLEWMGGITHFFGSTDYAQKFQGRVTITADESTTTAY MELSGLTSDDTAVYYCAREPNEFWNGYYTTHDFDSWGQGT TVTVSS |

TABLE 24-continued

List of amino acid sequences of
affinity matured B6 VH variants

| Clone | SEQ ID NO: | VH |
|---|---|---|
| J313M2S3#28 | 378 | EVQLVQSGAEVKKPGSSLKISCKASGGSFLSYGISWVRQA PGLGLEWMGGITLFFGTVDYAQKFQGRVTITADESTTTAY MELSGLTSDDTAVYYCAREPNEFWNGYYSTHDFDYWGQGT TVTVSS |
| J313M2S3#74 | 379 | EVQLVQSGAEVKKPGESLKISCKASGGSFRSYGISWVRQA PGQGLEWMGGITLFFGTVDYAQKFQGRVTITADESTTTAY MELSGLTSDDTAVYYCAREPNEFWNGYYATHDFDYWGQGT TVTVSS |
| J313M2S3#34 | 380 | EVQLVQSGAEVKKPGESLKISCKASGGSFRSYGISWVRQA PGQGLEWMGGITLFFGISDYAQKFQGRVTITADESTTTAY MELSGLTSDDTAVYYCAREPNEFWNGYYTTHDFDSWGQGT TVTVSS |
| J313M2S3#69 | 381 | EVQLVQSGAEVKKPGESLKISCKASGGSFRSYGISWVRQA PGQGLEWMGGITNFFGAVDYAQKFQGRVTITADESTTTAY MELSGLTSDDTAVYYCAREPNEFWNGYYTTHDFDAWGQGT TVTVSS |
| J313M2S3#85 | 382 | EVQLVQSGAEVKKPGESLKISCKASGGSFRSYGISWVRQA PGQGLEWMGGITNFFGMEDYAQKFQGRVTITADESTTTAY MELSGLTSDDTAVYYCAREPNEFWNGYYSTHDFDYWGQGT TVTVSS |
| J313M2S3#15 | 383 | EVQLVQSGAEVKKPGESLKISCKASGGSFSGYGTSWVRQA PGQGLEWMGGITHFFGAVDYAQKFQGRVTITADESTTTAY MELSGLTSDDTAVYYCARDPNEFWNGYYATHDFDYWGQGT TVTVSS |
| J313M2S3#31 | 384 | EVQLVQSGAEVKKPGESLKISCKASGGSFSGYGTSWVRQA PGQGLEWMGGITHFFGAVDYAQKFQGRVTITADESTTTAY MELSGLTSDDTAVYYCARDPHEFWNGYYATHDFDYWGQGT TVTVSS |
| J313M2S3#25 | 385 | EVQLVQSGAEVKKPGESLKISCKASGGSFSGYGTSWVRQA PGQGLEWMGGITHFFGAVDYAQKFQGRVTITADESTTTAY MELSGLTSDDTAVYYCARDPNEFWNGYYDTHDFDSWGQGT TVTVSS |
| J313M2S3#49 | 386 | EVQLVQSGAEVKKPGESVKVSCKASGGSFSGYGTSWVRQA PGQGLEWMGGITHFFGAVDYAQKFQGRVTITADESTTTAY MELSGLTSDDTAVYYCAREPNEFWNGYYSTHDFDYWGQGT TVTVSS |
| J313M2S3# 6 | 387 | EVQLVQSGAEVKKPGESVKVSCKASGGSFSGYGISWVRQA PGQGLEWMGGITNFFGIVDYAQKFQGRVTITADESTTTAY MELSGLTSDDTAVYYCARDPNEFWNGYYATHDFDYWGQGT TVTVSS |
| J313M2S3#75 | 388 | EVQLVQSGAEVKKPGESVKVSCKASGGSFSGYGISWVRQA PGQGLEWMGGITNFFGIVDYAQKFQGRVTITADESTTTAY MELSGLTSDDTAVYYCAREPNEFWNGYYATHDFDYWGQGT TVTVSS |
| J313M2S3#17 | 389 | EVQLVQSGAEVKKPGSSVKVSCKASGGSFGGYGIGWVRQA PGQGLEWMGGITPFFGFADYAQKFQGRVTITADESTTTAY MELSGLTSDDTAVYYCARDPNEFWNGYYSTHDFDSWGQGT TVTVSS |
| J313M2S3#79 | 390 | EVQLVQSGAEVKKPGSSVKVSCKASGGSFSSYGICWVRQA PGQGLEWMGGVTTFFGFADYAQKFQGRVTITADESTTTAY MELSGLTSDDTAVYYCARDPNEFWNGYYATHDFDYWGQGT TVTVSS |
| J313M2S3#94 | 391 | VQLVQSGAEVKKPGSSVKVSCKASGGSFTSYGISWVRQAP GQGLEWVGGITTFFGVADYAQKFQGRVTITADESTTTAYM ELSGLTSDDTAVYYCARDPHEFWNGYYATHDFDYWGQGTT VTVSS |
| J313M2S3#37 | 392 | EVQLVQSGAEVKKPGESVKVSCKASGGSFRGYGISWVRQAP GQGLEWMGGITHFFGMTDYAQKFQGRVTITADESTTTAYME LSGLTSDDTAVYYCARDPNEFWNGYYATHDFDYWGQGTTVT VSS |

TABLE 24-continued

List of amino acid sequences of
affinity matured B6 VH variants

| Clone | SEQ ID NO: | VH |
|---|---|---|
| J313M2S3#81 | 393 | EVQLVQSGAEVKKPGESVKVSCKASGGSFRSYGISWVRQA PGQGLEWMGGITTFFGTTDYAQKFQGRVTITADESTTTAY MELSGLTSDDTAVYYCARDPNEFWNGYYATHDFDYWGQGT TVTVSS |
| J313M2S3#77 | 394 | EVQLVQSGAEVKKPGESVKVSCKASGGSFRSYGIGWVRQA PGQGLEWMGGITNFFGVEDYAQKFQGRVTITADESTTTAY MELSGLTSDDTAVYYCARDPNEFWNGYYATHDFDYWGQGT TVTVSS |
| J313M2S3#54 | 395 | EVQLVQSGAEVKKPGESVKISCKASGGSFLSYGISWVRQA PGQGLEWMGGITHFFGISDYAQKFQGRVTITADESTTTAY MELSGLTSDDTAVYYCARDPNEFWNGYYATHDFDYWGQGT TVTVSS |
| J313M2S3#89 | 396 | EVQLVQSGAEVKKPGESVKISCKASGGSFPSYGISWVRQA PGQGLEWMGGITNFFGIRDYAQKFQGRVTITADESTTTAY MELSGLTSDDTAVYYCAREPNEFWNGYYATHDFDYWGQGT TVTVSS |
| J313M2S3#32 | 397 | EVQLVQSGAEVKKPGESVKISCKASGGSFSSYGISWVRQA PGQGLEWMGGITVFFGTADYAQKFQGRVTITADESTTTAY MELSGLTSDDTAVYYCARVPNEFWNGYYATQDFDYWGQGT TVTVSS |
| J313M2S3#55 | 398 | EVQLVQSGAEVKKPGSSVKISCKASGGSFSSYGISWVRQA PGQGLEWMGGITLFFGTTDYAQKFQGRVTITADESTTTAY MELSGLTSDDTAVYYCARDPNEFWNGYYDTHDFDSWGQGT TVTVSS |
| J313M2S3#27 | 399 | EVQLVQSGAEVKKPGSSVKISCKASGGSFRSYGISWVRQA PGQGLEWMGGITHFFGMVDYAQKFQGRVTITADESTTTAY MELSGLTSDDTAVYYCAREPNEFWNGYYATHDFDYWGQGT TVTVSS |
| J313M2S3#50 | 400 | EVQLVQSGAEVKKPGSSVKISCKASGGSFRSYGISWVRQA PGQGLEWMGGITHFFGMVDYAQKFQGRVTITADESTTTAY MELSGLTSDDTAVYYCAREPNEFWNGYYSTHDFDYWGQGT TVTVSS |
| J313M2S3#39 | 401 | EVQLVQSGAEVKKPGSSVKISCKASGGSFTSYGISWVRQA PGQGLEWMGGITNFFGSTDYAQKFQGRVTITADESTTTAY MELSGLTSDDTAVYYCAREPNEFWNGYYSTHDFDYWGQGT TVTVSS |
| J313M2S3#91 | 402 | EVQLVQSGAEVKKPGSSVKISCKASGGSFTSYGISWVRQA PGQGLEWMGGITNFFGSTDYAQKFQGRVTITADESTTTAY MELSGLTSDDTAVYYCAREPNEFWNGYFATNDFDYWGQGT TVTVSS |
| J313M2S3# 5 | 403 | EVQLVQSGAEVKKPGESVKISCKASGGSFRSYGISWVRQA PGQGLEWMGGITHFFGITDYAQKFQGRVTITADESTTTAY MELSGLTSDDTAVYYCAREPNDFWNGYYDTHDFDSWGQGT TVTVSS |
| J313M2S3#47 | 404 | EVQLVQSGAEVKKPGESVKVSCKASGGSFISYGISWVRQA PGQGLEWMGGITHFFGTVDYAQKFQGRVTITADESTTTAY MELSGLTSDDTAVYYCAREPNEFWNGYYTTHDFDSWGQGT TVTVSS |
| J313M2S3#72 | 405 | EVQLVQSGAEVKKPGESVKVSCKASGGSFISYGFSWVRQA PGQGLEWMGGITVFFGHVYYAQKFQGRVTITADESTTTAY MELSGLTSDDTAVYYCAREPNEFWNGYYSTHDFDYWGQGT TVTVSS |
| J313M2S3# 1 | 406 | EVQLVQSGAEVKKPGSSVKVSCKASGGSFISYGYNWVRQA PGQGLEWMGGITPFFGTADYAQKFQGRVTITADESTTTAY MELSGLTSDDTAVYYCARESSEFWNGYYCTQDFDLWGQGT TVTVSS |
| J313M2S3#44 | 407 | EVQLVQSGAEVKKPGSSVKVSCKASGGSFLSYGFSWVRQA PGQGLEWMGGITPFFGLADYAQKFQGRVTITADESTTTAY MELSGLTSDDTAVYYCARESSEFWNGYYCTQDFDLWGQGT TVTVSS |

TABLE 24-continued

List of amino acid sequences of affinity matured B6 VH variants

| Clone | SEQ ID NO: | VH |
|---|---|---|
| J313M2S3# 3 | 408 | EVQLVQSGAEVKKPGESLKISCKASGGSFTTYGMNWVRQAPGQGLEWMGGITPFFGWADYAQKFQGRVTITADESTTTAYMELSGLTSDDTAVYYCARESSEFWNGYYCTQDFDLWGQGTTVTVSS |
| J313M2S3#29 | 409 | EVQLVQSGAEVKKPGESLKISCKASGGSFSSYGFGWVRQAPGQGLEWMGGITPFFGIADYAQKFQGRVTITADESTTTAYMELSGLTSDDTAVYYCARESSEFWNGYYVTNDFDYWGQGTTVTVSS |
| J299M2S3#10 | 410 | EVQLVQSGAEVKKPGESLKISCKASGGSFRSYGISWVRQAPGQGLEWMGGITPILGTANYAQKFQGRVTITADESTTTAYMELSGLTSDDTAVYYCARESNEFWNGYYPTLDLDSWGQGTTVTVSS |
| J299M2S3#23 | 411 | EVQLVQSGAEVKKPGESLKISCKASGGSFRSYGISWVRQAPGQGLEWMGGITPILGTANYAQKFQGRVTITADESTTTAYMELSGLTSDDTAVYYCARESNEFWNGYYPTQDYDFWGQGTTVTVSS |
| J299M2S3#20 | 412 | EVQLVQSGAEVKKPGESLKISCKASGGSFRSYGISWVRQAPGQGLEWMGGITPILGTANYAQKFQGRVTITADESTTTAYMELSGLTSDDTAVYYCARESSAFWNGYYNTNDLDYWGQGTTVTVSS |
| J299M2S3#35 | 413 | EVQLVQSGAEVKKPGESLKISCKASGGSFRSYGISWVRQAPGQGLEWMGGITPILGTANYAQKFQGRVTITADESTTTAYMELSGLTSDDTAVYYCARESTEFWNGYYNTNDYDNWGQGTTVTVSS |
| J299M2S3#16 | 414 | EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDFDYWGQGTTVTVSS |
| J299M2S3#18 | 415 | EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDLDYWGQGTTVTVSS |
| J299M2S3#27 | 416 | EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDFDCWGQGTTVTVSS |
| J299M2S3#15 | 417 | EVQLVQSGAEVKKPGESLKISCKASGGSFRSYGISWVRQAPGQGLEWMGGITPILGTANYAQKFQGRVTITADESTTTAYMELSGLTSDDTAVYYCARVPNEFWNGYFPTQDFDYWGQGTTVTVSS |
| J299M2S3#17 | 418 | EVQLVQSGAEVKKPGESLKISCKASGGSFRSYGISWVRQAPGQGLEWMGGITPILGTANYAQKFQGRVTITADESTTTAYMELSGLTSDDTAVYYCARETNEFWNGYFPTQDFDYWGQGTTVTVSS |
| J299M2S3#43 | 419 | EVQLVQSGAEVKKPGESLKISCKASGGSFRSYGISWVRQAPGQGLEWMGGITPILGTANYAQKFQGRVTITADESTTTAYMELSGLTSDDTAVYYCAREPNEFWNGYFPTQDFDYWGQGTTVTVSS |
| J299M2S3#32 | 420 | EVQLVQSGAEVKKPGESLKISCKASGGSFRSYGISWVRQAPGQGLEWMGGITPILGTANYAQKFQGRVTITADESTTTAYMELSGLTSDDTAVYYCAREPNEFWNGYFPTLDFDCWGQGTTVTVSS |
| J299M2S3#42 | 421 | EVQLVQSGAEVKKPGESLKISCKASGGSFRSYGISWVRQAPGQGLEWMGGITPILGTANYAQKFQDRVTITADESTTTAYMELSGLTSDDTAVYYCAREPNEFWNGYFATNDFDYWGQGTTVTVSS |
| J299M2S3#11 | 422 | EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYATNDFDYWGQGTTVTVSS |

TABLE 24-continued

List of amino acid sequences of
affinity matured B6 VH variants

| Clone | SEQ ID NO: | VH |
|---|---|---|
| J299M2S3#13 | 423 | EVQLVQSGAEVKKPGESLKISCKASGGSFRSYGISWVRQA PGQGLEWMGGITPILGTANYAQKFQGRVTITADESTTTAY MELSGLTSDDTAVYYCAREPNDFWNGYYSTDHFDCWGQGT TVTVSS |
| J299M2S3#14 | 424 | EVQLVQSGAEVKKPGESLKISCKASGGSFRSYGISWVRQA PGQGLEWMGGITPILGTANYAQKFQGRVTITADESTTTAY MELSGLTSDDTAVYYCARVPNDFWNGYFATDYFDDWGQGT TVTVSS |
| J299M2S3#21 | 425 | EVQLVQSGAEVKKPGESLKISCKASGGSFRSYGISWVRQA PGQGLEWMGGITPILGTANYAQKFQGRVTITADESTTTAY MELSGLTSDDTAVYYCAREPNDFWNGYFATDHFDFWGQGT TVTVSS |
| J299M2S3#28 | 426 | EVQLVQSGAEVKKPGESLKISCKASGGSFRSYGISWVRQA PGQGLEWMGGITPILGTANYAQKFQGRVTITADESTTTAY MELSGLTSDDTAVYYCAREPNDFWNGYYDTDHFDYWGQGT TVTVSS |
| J299M2S3#2 | 427 | EVQLVQSGAEVKKPGESLKISCKASGGSFRSYGISWVRQA PGQGLEWMGGITPILGTANYAQKFQGRVTITADESTTTAY MELSGLTSDDTAVYYCARDPNEFWNGYYATHDFDHWGQGT TVTVSS |
| J313M2S3#23 | 428 | EVQLVQSGAEVKKPGSSVKISCKASGGSFGSYGISWVRQA PGQGLEWMGGITPFFGWADYAQKFQGRVTITADESTTTAY MELSGLTSDDTAVYYCAREPNEFWNGYYSTDHFDYWGQGT TITVSS |
| J294M2S3#27 | 429 | EVQLVQSGAEVKKPGESVKISCKASGGSFPSYGISWVRQA PGQGLEWMGGITFFFGAADYAQKFQGRVTITADESTTTAY MELSGLTSDDTAVYYCAREPNDFWNGYYTTHHFDYWGQGT TVTVSS |
| J313M2S3#62 | 430 | EVQLVQSGAEVKKPGESVKISCKASGGSFISYGTSWVRQA PGQGLEWMGGITHFFGTTDYAQKFQGRVTITADESTTTAY MELSGLTSDDTAVYYCAREPNDFWNGYYTTHHFDYWGQGT TVTVSS |
| J294M2S3#1 | 431 | EVQLVQSGAEVKKPGESVKISCKASGGSFISYCTSWVRQA PGQGLEWMGGITHFFGSADYAQKFQGRVTITADESTTTAY MELSGLTSDDTAVYYCAREPNDFWNGYYTTHHFDYWGQGT TVTVSS |
| J294M2S3#39 | 432 | EVQLVQSGAEVKKPGESLKISCKASGGSFRSYSTSWVRQA PGQGLEWMGGITHFFGTADYAQKFQGRVTITADESTTTAY MELSGLTSDDTAVYYCAREPNDFWNGYYTTHHFDYWGQGT TVTVSS |
| J313M2S3#65 | 433 | EVQLVQSGAEVKKPGESLKISCKASGGSFISYGISWVRQA PGQGLEWMGGITHFFGSTDYAQKFQGRVTITADESTTTAY MELSGLTSDDTAVYYCAREPNDFWNGYYTTHHFDYWGQGT TVTVSS |
| J294M2S3#14 | 434 | EVQLVQSGAEVKKPGESLKISCKASGGSFRSYGISWVRQA PGQGLEWMGGITHFFGTTDYAQKFQGRVTITADESTTTAY MELSGLTSDDTAVYYCAREPNDFWNGYYTTHHFDYWGQGT TVTVSS |
| J299M2S3#24 | 435 | EVQLVQSGAEVKKPGESLKISCKASGGSFRSYGISWVRQA PGQGLEWMGGITHFFLTTDYAQKFQGRVTITADESTTTAY MELSGLTSDDTAVYYCAREPNDFWNGYYTTHHFDYWGQGT TVTVSS |
| J294M2S3#42 | 436 | EVQLVQSGAEVKKPGESLKVSCKASGGSFTSYGISWVRQA PGQGLEWMGGITHMFATTDYAQKFQGRVTITADESTTTAY MELSGLTSDDTAVYYCAREPNDFWNGYYTTHHFDYWGQGT TVTVSS |
| J294M2S3#5 | 437 | EVQLVQSGAEVKKPGESLKISCKASGGSFISYGISWVRQA PGQGLEWMGGITPFLGATDYAQKFQGRVTITADESTTTAY MELSGLTSDDTAVYYCAREPNDFWNGYYTTHHFDYWGQGT TVTVSS |

TABLE 24-continued

List of amino acid sequences of
affinity matured B6 VH variants

| Clone | SEQ ID NO: | VH |
|---|---|---|
| J294M2S3#19 | 438 | EVQLVQSGAEVKKPGSSLKISCKASGGSFRSYGISWVRQA PGQGLEWMGGITPFFGFIDYAQKFQGRVTITADESTTTAY MELSGLTSDDTAVYYCAREPNDFWNGYYTTHHFDYWGQGT TVTVSS |
| J294M2S3#44 | 439 | EVQLVQSGAEVKKPGESLKISCKASGGSFRSYVISWVRQA PGQGLEWMGGITPFFGTVDYAQKFQGRVTITADESTTTAY MELSGLTSDDTAVYYCAREPNDFWNGYYTTHHFDYWGQGT TVTVSS |
| J294M2S3#12 | 440 | EVQLVQSGAEVKKPGESLKISCKASGGSFIVYGFSWVRQA PGQGLEWMGGITPFLGTVDYAQKFQGRVTITADESTTTAY MELSGLTSDDTAVYYCAREPNDFWNGYYTTHHFDYWGQGT TVTVSS |
| J294M2S3#2 | 441 | EVQLVQSGAEVKKPGESLKVSCKASGGSFLTYGFSWVRQA PGQGLEWMGGITTFLGTVNYAQKFQGRVTITADESTTTAY MELSGLTSDDTAVYYCAREPNDFWNGYYTTHHFDYWGQGT TVTVSS |
| J294M2S3#23 | 442 | EVQLVQSGAEVKKPGESLKISCKASGGSFTSYVFSWVRQA PGQGLEWMGGITPLLGISDYAQKFQGRVTITADESTTTAY MELSGLTSDDTAVYYCAREPNDFWNGYYTTHHFDYWGQGT TVTVSS |
| J294M2S3#34 | 443 | EVQLVQSGAEVKKPGESLKISCKASGGSFTSYGVSWVRQA PGQGLEWMGGITTILGTSDYAQKFQGRVTITADESTTTAY MELSGLTSDDTAVYYCAREPNDFWNGYYTTHHFDYWGQGT TVTVSS |
| J294M2S3#47 | 444 | EVQLVQSGAEVKKPGESLKISCKASGGSFISYGFSWVRQA PGQGLEWMGGITPIFGTGDYAQKFQGRVTITADESTTTAY MELSGLTSDDTAVYYCAREPNDFWNGYYTTHHFDYWGQGT TVTVSS |
| J294M2S3#15 | 445 | EVQLVQSGAEVKKPGESVKISCKASGGSFWSYDFSWVRQA PGQGLEWMGGITTFFESADYAQKFQGRVTITADESTTTAY MELSGLTSDDTAVYYCAREPNDFWNGYYTTHHFDYWGQGT TVTVSS |
| J294M2S3#25 | 446 | EVQLVQSGAEVKKPGSSLKISCKASGGSFTSYDFSWVRQA PGQGLEWMGGITTFFGLADYAQKFQGRVTITADESTTTAY MELSGLTSDDTAVYYCAREPNDFWNGYYTTHHFDYWGQGT TVTVSS |
| J294M2S3#21 | 447 | EVQLVQSGAEVKKPGESLKISCKASGGSFSGYDFSWVRQA PGQGLEWMGGITPFFGSAYYAQKFQGRVTITADESTTTAY MELSGLTSDDTAVYYCAREPNDFWNGYYTTHHFDYWGQGT TVTVSS |
| J294M2S3#24 | 448 | EVQLVQSGAEVKKPGESLKISCKASGGSFSSYVFSWVRQA PGQGLEWMGGITPFFGIADYAQKFQGRVTITADESTTTAY MELSGLTSDDTAVYYCAREPNDFWNGYYTTHHFDYWGQGT TVTVSS |
| J313M2S3#88 | 449 | EVQLVQSGAEVKKPGSSVKISCKASGGSFTSYGISWVRQA PGQGLEWMGGITNFFGSTDYAQKFQGRVTITADESTTTAY MELSGLTSDDTAVYYCAREPNDFWNGYYTTHHFDYWGQGT TVTVSS |
| J294M2S3#13 | 450 | EVQLVQSGAEVKKPGSSVKVSCKASGGSFGSYVISWVRQA PGQGLEWMGGITPFFGSTDYAQKFQGRVTITADESTTTAY MELSGLTSDDTAVYYCAREPNDFWNGYYTTHHFDYWGQGT TVTVSS |
| J313M2S3#93 | 451 | EVQLVQSGAEVKKPGSSVKVSCKASGGSFSSYGISWVRQA PGQGLEWMGGITHFFGTTDYAQKFQGRVTITADESTTTAY MELSGLTSDDTAVYYCAREPNDFWNGYYTTHHFDYWGQGT TVTVSS |
| J294M2S3#28 | 452 | EVQLVQSGAEVKKPGSSVKVSCKASGGSFRSYIISWVRQA PGQGLEWMGGITPFFGTADYAQKFQGRVTITADESTTTAY MELSGLTSDDTAVYYCAREPNDFWNGYYTTHHFDYWGQGT TVTVSS |

TABLE 24-continued

List of amino acid sequences of
affinity matured B6 VH variants

| Clone | SEQ ID NO: | VH |
|---|---|---|
| J294M2S3#16 | 453 | EVQLVQSGAEVKKPGSSLKVSCKASGGSFISYGYSWVRQA PGQGLEWMGGITTFFGTTDYAQKFQGRVTITADESTTTAY MELSGLTSDDTAVYYCAREPNDFWNGYYTTHHFDYWGQGT TVTVSS |
| J294M2S3#29 | 454 | EVQLVQSGAEVKKPGSSVKVSCKASGGSFISYGYNWVRQA PGQGLEWMGGITPFFGTADYAQKFQGRVTITADESTTTAY MELSGLTSDDTAVYYCAREPNDFWNGYYTTHHFDYWGQGT TVTVSS |
| J294M2S3#11 | 455 | EVQLVQSGAEVKKPGSSVKVSCKASGGSFLSYGFSWVRQA PGQGLEWMGGITPFFGFADYAQKFQGRVTITADESTTTAY MELSGLTSDDTAVYYCAREPNDFWNGYYTTHHFDYWGQGT TVTVSS |
| J294M2S3#37 | 456 | EVQLVQSGAEVKKPGESVKVSCKASGGSFSSYVFSWVRQA PGQGLEWMGGITPFFGTADYAQKFQGRVTITADESTTTAY MELSGLTSDDTAVYYCAREPNDFWNGYYTTHHFDYWGQGT TVTVSS |
| J294M2S3#10 | 457 | EVQLVQSGAEVKKPGSSVKVSCKASGGSFISYDYSWVRQA PGQGLEWMGGITPFFGIVNYAQKFQGRVTITADESTTTAY MELSGLTSDDTAVYYCAREPNDFWNGYYTTHHFDYWGQGT TVTVSS |
| J294M2S3#8 | 458 | EVQLVQSGAEVKKPGESVKVSCKASGGSFGSYDYSWVRQA PGQGLEWMGGITTFFGASTYAQKFQGRVTITADESTTTAY MELSGLTSDDTAVYYCAREPNDFWNGYYTTHHFDYWGQGT TVTVSS |
| J294M2S3#30 | 459 | EVQLVQSGAEVKKPGSSVKISCKASGGSFHSYDYSWVRQA PGQGLEWMGGITSFFGTEDYAQKFQGRVTITADESTTTAY MELSGLTSDDTAVYYCAREPNDFWNGYYTTHHFDYWGQGT TVTVSS |
| J294M2S3#33 | 460 | EVQLVQSGAEVKKPGSSVKISCKASGGSFTGYVYSWVRQA PGQGLEWMGGITPFFGTADYAQKFQGRVTITADESTTTAY MELSGLTSDDTAVYYCAREPNDFWNGYYTTHHFDYWGQGT TVTVSS |
| J294M2S3#17 | 461 | EVQLVQSGAEVKKPGESVKVSCKASGGSFTSYDFSWVRQA PGQGLEWMGGITPFLGTAIYAQKFQGRVTITADESTTTAY MELSGLTSDDTAVYYCAREPNDFWNGYYTTHHFDYWGQGT TVTVSS |
| J294M2S3#20 | 462 | EVQLVQSGAEVKKPGESVKISCKASGGSFSSYDFSWVRQA PGQGLEWMGGITPILGTENYAQKFQGRVTITADESTTTAY MELSGLTSDDTAVYYCAREPNDFWNGYYTTHHFDYWGQGT TVTVSS |
| J294M2S3#38 | 463 | EVQLVQSGAEVKKPGESVKISCKASGGSFSSYDYSWVRQA PGQGLEWMGGITPFLGMSSYAQKFQGRVTITADESTTTAY MELSGLTSDDTAVYYCAREPNDFWNGYYTTHHFDYWGQGT TVTVSS |
| J294M2S3#36 | 464 | EVQLVQSGAEVKKPGESLKISCKASGGSFTRYDFSWVRQA PGQGLEWMGGITPFLGTSNYAQKFQGRVTITADESTTTAY MELSGLTSDDTAVYYCAREPNDFWNGYYTTHHFDYWGQGT TVTVSS |
| J294M2S3#6 | 465 | EVQLVQSGAEVKKPGSSLKISCKASGGSFISYDFSWVRQA PGQGLEWMGGITPFLGFSNYAQKFQGRVTITADESTTTAY MELSGLTSDDTAVYYCAREPNDFWNGYYTTHHFDYWGQGT TVTVSS |
| J294M2S3#18 | 466 | EVQLVQSGAEVKKPGSSVKISCKASGGSFSSYDFSWVRQA PGQGLEWMGGITPFLGTADYAQKFQGRVTITADESTTTAY MELSGLTSDDTAVYYCAREPNDFWNGYYTTHHFDYWGQGT TVTVSS |
| J294M2S3#35 | 467 | EVQLVQSGAEVKKPGSSVKISCKASGGSFSSYDFSWVRQA PGQGLEWMGGITTFLGTVVYAQKFQGRVTITADESTTTAY MELSGLTSDDTAVYYCAREPNDFWNGYYTTHHFDYWGQGT TVTVSS |

TABLE 24-continued

List of amino acid sequences of affinity matured B6 VH variants

| Clone | SEQ ID NO: | VH |
|---|---|---|
| J294M2S3#32 | 468 | EVQLVQSGAEVKKPGSSVKISCKASGGSFSSYVVSWVRQA PGQGLEWMGGITPFLGTVDYAQKFQGRVTITADESTTTAY MELSGLTSDDTAVYYCAREPNDFWNGYYTTHHFDYWGQGT TVTVSS |
| J294M2S3#22 | 469 | EVQLVQSGAEVKKPGSSVKISCKASGGSFISYGFHWVRQA PGQGLEWMGGITPFFGTDNYAQKFQGRVTITADESTTTAY MELSGLTSDDTAVYYCAREPNDFWNGYYTTHHFDYWGQGT TVTVSS |
| J294M2S3#41 | 470 | EVQLVQSGAEVKKPGESVKISCKASGGSFISYGFSWVRQA PGQGLEWMGGITPFFGLGTYAQKFQGRVTITADESTTTAY MELSGLTSDDTAVYYCAREPNDFWNGYYTTHHFDYWGQGT TVTVSS |
| J294M2S3#31 | 471 | EVQLVQSGAEVKKPGESVKISCKASGGSFLSYDFSWVRQA PGQGLEWMGGITPFFGAANYAQKFQGRVTITADESTTTAY MELSGLTSDDTAVYYCAREPNDFWNGYYTTHHFDYWGQGT TVTVSS |
| J294M2S3#48 | 472 | EVQLVQSGAEVKKPGESVKISCKASGGSFLSYGFSWVRQA PGQGLEWMGGITPFFGTADYAQKFQGRVTITADESTTTAY MELSGLTSDDTAVYYCAREPNDFWNGYYTTHHFDYWGQGT TVTVSS |

The table below provides a list of amino acid sequences of VL regions of affinity matured fully human IL-17 antibodies derived from IL-17-TN-K7-B6. Amino acid residues of individual CDRs of each VL sequence are indicated in bold.

TABLE 25

| Clone | SEQ ID NO: | Light Chain Variable Region (VL) |
|---|---|---|
| J313M2S3#11 | 473 | EIVLTQSPDFQSVTPKEKVTITCRASQIIGSELHWYQ QKPDQSPKLLIKYASHSISGVPSRFSGSGSGTDFTLT INGLEAEDAGTYYCHQSYDLPHTFGQGTKVDIK |
| J313M2S3#88 | 474 | EIVLTQPPDFQSVTPKEKVTITCRASQDIGSELHWYQ QKPDQSPKLLIKYASHSISGVPSRFSGSGSGTDFTLT INGLEAEDAGTYYCHQSYDLPYTFGQGTKVDIK |
| J313M2S3#32 | 475 | EIVLTQSPDFQSVTPKEKVTITCRASQDIGSELHWYQ QKPDQSPKLLIKYASHSISGVPSRFSGSGSGTDFTLT INSLEAEDAGTYYCHQSYWLPNTFGQGTKVDIK |
| J313M2S3#77 | 476 | EIVLTQSPDFQSVTPKEKVTITCRASQDIGSELHWYQ QKPDQSPKLLIKYASHSGSGVPSRFSGSGSGTDFTLT INSLEAEDAATYYCHQSYNLPITFGQGTKVDIK |
| J313M2S3#28 | 477 | EIVLTQSPDFQSVTPKEKVTITCRASQNIGSELHWYQ QKPDQSPKLLIKYASWSQSGVPSRFSGSGSGTDFTLT INGLEAEDAGTYYCHQSYDLPYTFGQGTKVDIK |
| J313M2S3#12 | 478 | EIVLTQSPDFQSVTLKEKVTITCRASQDIGSELHWYQ QKPDQSPKLLIKYASNSISGVPSRFSGSGSGTDFTLT INGLEAEDAGTYYCHQSMSLPHTFGQGTKVDIK |
| J294M2S3#10 | 479 | EIVLTQSPDFQSVTPKEKVTITCRASQNIGSALHWYQ QKPDQSPKLLIKYASQSISGVPSRFSGSGSGTDFTLT INGLEAEDAGTYYCHQSTSLPHTFGQGTKVDIK |
| J294M2S3#21 | 480 | EIVLTQSPDFQSVTPKEKVTITCRASQNIGSALHWYQ QKPDQSPKLLIKYASQSISGVPPRFSGSGSGTDFTLT INGLEAEDAGTYYCHQSTSLPHTFGQGTKVDIK |
| J294M2S3#35 | 481 | EIVLTQSPDFQSVTPKEKVTITCRASQNIGSALHWYQ QKPDQSPKLLIKYASQSISGVPSRFSGSGSGADFTLT INGLEAEDAGTYYCHQSTSLPHTFGQGTKVDIK |
| J299M2S3#17 | 482 | EIVLTQSPDFQSVTPKEKVTITCRASQNIGSALHWYQ QKPDQSPKLLIKYASQSISGVPSRFGGSGSGTDFTLT INGLEAEDAGTYYCHQSTSLPHTFGQGTKVDIK |

TABLE 25-continued

| Clone | SEQ ID NO: | Light Chain Variable Region (VL) |
|---|---|---|
| J299M2S3#42 | 483 | EIVLTQSPDFQSVTPKEKVTITCRASQNIGSALHWYQQKPDQSPKLLVKYASQSISGVPSRFSGSGSGTDFTLTINGLEAEDAGTYYCHQSTSLPHTFGQGTKVDIK |
| J294M2S3#44 | 484 | EIVLTQSPDFQSVTPKEKVTITCRASQNIGSALHWYQQKPDQPPKLLIKYASQSISGVPSRFSGSGSGTDFTLTINGLEAEDAGTYYCHQSTSLPHTFGQGTKVDIK |
| J294M2S3#16 | 485 | EIVLTQSPDFQSVTPKEKVTITCRASQNIGSALHWYQQKPGQSPKLLIKYASQSISGVPSRFSGSGSGTDFTLTINGLEAEDAGTYYCHQSTSLPHTFGQGTKVDIK |
| J299M2S3#11 | 486 | EIVLTQSPDFQSATPKEKVTITCRASQNIGSALHWYQQKPDQSPKLLIKYASQSISGVPSRFSGSGSGTDFTLTINGLEAEDAGTYYCHQGTSLPHTFGQGTKVDIK |
| J299M2S3#13 | 487 | EIVLTQSPDFQSVTPKEKVTITCRASQNIGSALHWYQQKPDQSPKLLIKYASQSISGVPSRFSGSGSGTDFTLTINGLEAEDAGTYYCHQGTSLPHTFGQGTKVDIK |
| J299M2S3#14 | 488 | EIVLTQSPDFQSVTPKEKVTITCRASQDIGSALHWYQQKPDQSPKLLIKYASQSISGVPSRFSGSGSGTDFTLTINGLEAEDAGTYYCHQSTSLPHTFGQGTKVDIK |
| J313M2S3#16 | 489 | EIVLTQSPDFQSVTPKEKVTITCRASQDIGSALHWYQQKPDQSPKLLIKYASHSVSGVPSRFSGSGSGTDFTLTINGLEAEDAGTYYCHQSDILPHTFGPGTKVDIK |
| J313M2S3#50 | 490 | EIVLTQSPDFQSVTPKGKVTITCRASQDIGSALHWYQQKPDQSPKLLIKYASYSVSGVPSRFSGSGSGTDFTLTINGLEAEDAGTYYCHQSDILPHTFGPGTKVDIK |
| J313M2S3#69 | 491 | EIVLTQSPDFQSVTPKEKVTITCRASQDIGAALHWYQQKPDQSPKLLIKYASHSNPGVPSRFSGSGSGTDFTLTINGLEAEDAGTYYCHQSDILPQTFGQGTKVDIK |
| J313M2S3#39 | 492 | EIVLTQSPDFQSVTPKEKVTITCRASQNIGSSLHWYQQKPDQSPKLLIKYASHSISGVPSRFSGSGSGTDFTLTINGLEAEDAGTYYCHQSDFLPHTFGQGTKVDIK |
| J313M2S3#85 | 493 | EIVLTQSPDFQSVTPKEKVTITCRASQNIGSSLHWYQQKPDQSPKLLIKYASYPISGVPSRFSGSGSGTDFTLTINGLEAEDAGTYYCHQSDILPHTFGQGTKVDIK |
| J313M2S3#94 | 494 | EIVLTQSPDFRSVTPKEKVTITCRASQNIGSALHWYQQKPDQSPKLLIKYASHSISGVPSRFSGSGSGTDFTLTINGLEAEDAGTYYCHQSDDLPYTFGQGTKVDIK |
| J313M2S3#2 | 495 | EIVLTQSPDFQSVTPKEKVTITCRASQDIGSELHWYQQKPDQSPKLLIKYASHSNSGVPSRFSGSGSGTDFTLTINGLEAEDAGTYYCGTYYCHQSSWLPHTFGPGTKVDIK |
| J313M2S3#86 | 496 | EIVLTQSPDFQSVTPKEKVTITCRASQDIGSELHWYQQKPDQSPKLLIKYASESMSGVPSRFSGSGSGTDFTLTINGLEAEDAGTYYCHQSS#LPHSFGPGTKVDIK |
| J313M2S3#89 | 497 | EIVLTQSPDFQSVTPKEKVTITCRASQDIGYELHWYQQKPDQSPKLLIKYASHSISGVPSRFSGSGSGTDFTLTINGLEAEDAGTYYCHQSSELPHTFGRGTKVDIK |
| J313M2S3#91 | 498 | EIVLTQSPDFQSVTPKEKVTITCRASQNIGSELHWYQQKPGQSPKLLIKYASYSSSGVPSRFSGSGSGTDFTLTINGLEAEDAGTYYCHQSSCLPHTFGQGTKVGIK |
| J313M2S3#13 | 499 | EIVLTQSPDFQSVTPKEKVTITCRASQEIGFALHWYQQKPGQSPKLLIKYASHSISGVPSRFSGSGSGTDFTLTINGLEAEDAGTYYCHQTEELPYTFGPGTKVDIK |
| J313M2S3#15 | 500 | EIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIK |
| J313M2S3#78 | 501 | EIVLTQSPDFQSVTPKEKVTITCRASQNIGSELHWYQQKPDQSPKLLIKYASHSISGVPSRFSGSGSGTDFTLTINGLEAEDAGTYYCHQTFSLPYTFGPGTKVDIK |
| J313M2S3#17 | 502 | DIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIK |

TABLE 25-continued

| Clone | SEQ ID NO: | Light Chain Variable Region (VL) |
|---|---|---|
| J313M2S3#93 | 503 | EIVLTQSPDFQSVTPKEKVTITCRASQDIGSELHWYQQKPDQSPKLLIKYASHSVSGVPSRFSGSGSGTDFTLTINGLEAEDAGTYYCHQTSDLPYTFGPGTKVDIK |
| J313M2S3#49 | 504 | EIVLTQSPDFQSVTPKEKVTITCRASQNIGSELHWYQQKPDQSPKLLIKYASHSMSGVPSRFSGSGSGTDFTLTINGLEAEDAATYYCHQTNSLPYTFGPGTKVDIK |
| J313M2S3#9 | 505 | EIVLTQSPDFQSVTPKEKVTITCRASQDIGSGLHWYQQKPDQSPKLLIKYASESMSGVPSRFSGSGSGTDFTLTINGLEAEDAATYYCHQTDWLPYTFGPGTKVDIK |
| J313M2S3#3 | 506 | EIVLTQSPDFQSVTPREKVTITCRASQDIGSDLHWYQQKPDQSPKLLIKYASHSISGVPSRFSGSGSGTDFTLTINGLEAEDAGTYYCHQTNSLPYTFGQGTKVDIK |
| J313M2S3#37 | 507 | EIVLTQSPDFQSVTPKEKVTITCRASQDIDSDLHWYQQKPDQSPKLLIKYASHSISGVPSRFSGSGSGTDFTLTINGLEAEDAGTYYCHQTFNLPYTFGPGTKVDIK |
| J313M2S3#44 | 508 | EIVLTQSPDFQSVTPKEKVTITCRASQDIGSDLHWYQQKPDQSPKLLIKYASNSISGVPSRFSGSGSGTDFTLTINGLEAEDAGTYYCHQTAYLPQTFGPGTIVDIK |
| J313M2S3#42 | 509 | EIVLTQSPDFQSVTPKEKVTITCRASQDIGSDLHWYQQKPDQSPKLLIKYASYSTSGVPSRFSGSGSGTDFTLTINGLEAEDAGTYYCHQTDGLPYTFGQGTKVDIK |
| J313M2S3#62 | 510 | EIVLTQSPDFQSVTPKEKVTITCRASQDIGSELHWYQQKPDQSPKLLIKYASESISGVPSRFSGSGSGTDFTLTINGLEAEDAGTYYCHQTDSLPYTFGQGTKVDIK |
| J313M2S3#65 | 511 | EIVLTQSPDFQSVTPKEKVTITCRASQDIGSELHWYQQKPDQSPKLLIKYASHSASGVPSRFSGSGSGTDFTLTINGLEAEDAGTYYCHQTTLLPYTFGQGTKVDIK |
| J313M2S3#23 | 512 | EIVLTQSPDFQSVTPKGKVTITCRASQDIGSELHWYQQKPDQSPKLLIKYASHSGSGVPSRFSGSGSGTDFTLTINGLEAEDAGTYYCHQGFSLPHTFGQGTKVDIK |
| J313M2S3#74 | 513 | EVVLTQSPDFQSVTPKEKVTITCRASQDIGSELHWYQQKPDQSPKLLIKYASESGSGVPSRFSGSGSGTDFTLTINGLEAEDAGTYYCHQSFCLPYTFGQGTKVDIK |
| J313M2S3#26 | 514 | EIVLTQSPDFQSVTPKEKVTITCRASQDIGSELHWYQQKPDQSPKLLIKYASSSTSGVPSRFSGSGSGTDFTLTINGLEAEDAGTYYCHQSTSLPYTFGQGTKVDIK |
| J313M2S3#54 | 515 | EIVLTQSPDFQSVTPKEKVTITCRASQDIGSELHWYQQKPDQSPKLLIKYASSSLSGVPSRFSGSGSGTDFTLTINGLEAEDAGTYYCHQSDYLPYTFGQGTIVDIK |
| J313M2S3#1 | 516 | EIVLTQSPDFQSVTPKEKVTITCRASQDIGEALHWYQQKPDQSPKLLIKYASHSISGVPSRFSGSGSGTDFTLTINGLEAEDAATYYCHQSDWLPYTFGQGTKVDIK |
| J313M2S3#18 | 517 | EIVLTQSPDFQSVTPKEKVTITCRASQEIGASLHWYQQKPDQSPKLLIKYASHSASGVPSRFSGSGSGTDFTLTINSLEAEDAATYYCHQSDGLPYTFGQGTKVDIK |
| J313M2S3#55 | 518 | EIVLTQSPDFQSVTPKEKVTITCRASQDIGGELHWYQQKPDQSPKLLIKYASHSISGVPSRFSGSGSGTDFTLTINGLEAEDAATYYCHQSNDLPYTFGQGTKVDIK |
| J313M2S3#59 | 519 | EIVLTQSPDFQSVTPKEKVTITCRASQDIETELHWYQQKPDQSPKLLIKYASHSISGVPSRFSGSGSGTDFTLTINGLEAEDAATYYCHQTYGLPYTFGQGTKVDIK |
| J313M2S3#24 | 520 | EIVLTQSPDFQSVTPKEKVTITCRASQNIGSDLHWYQQKPDQSPKLLIKYASHSISGVPSRFSGSGSGTDFTLTINGLEAEDAATYYCHQSMGLPYTFGQGTKVDIK |
| J313M2S3#25 | 521 | EIVLTQSPDFQSVTPKEKVTITCRASQNIGYELHWYQQKPDQSPKLLIKYASHSISGVPSRFSGSGSGTDFTLTINGLEAEDAATYYCHQSFTLPYTFGPGTKVDIK |

TABLE 25-continued

| Clone | SEQ ID NO: | Light Chain Variable Region (VL) |
|---|---|---|
| J313M2S3#47 | 522 | EIVLTQSPDFQSVTPKEKVTITCRASQNIGTELHWYQQKPDQSPKLLIKYASHCISGVPSRFSGSGSGTDFTLTINGLEAEDAATYYCHQSESLPHTFGQGTKVDIK |
| J313M2S3#5 | 523 | EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIK |
| J313M2S3#14 | 524 | EIVLTQSPDFQSVTPKEKVTITCRASQDIGSELHWYQQKPDQSPKLLIKYASESVSGVPSRFSGSGSGTDFTLTINGLEAEDAATYYCHQSTNLPYTFGQGTKVDIK |
| J313M2S3#34 | 525 | EIVLTQSPDFQSVTPKEKVTITCRASQDIGSELHWYQQKPDQSPKLLIKYASHSVSGVPSRFSGSGSGTDFTLTINGLEAEDAATYYCHQSSILPHTFGQGTKVDIK |
| J313M2S3#45 | 526 | EIVLTQSPDFQSVTPKEKVTITCRASQNIGSELHWYQQKPDQSPKLLIKYASHSVSGVPSRFSGSGSGTDFTLTINGLEAEDAATYYCHQSTWLPYTFGQGTKVDIK |
| J313M2S3#90 | 527 | EIVLTQSPDFQSVTPKEKVTITCRASQNIGSELHWYQQKPDQSPKLLIKYASHSVSGVPSRFSGSGSGTDFTLTINGLEAEDAATYYCHQSAFLPYIFGQGTKVDIK |
| J313M2S3#27 | 528 | EIVLTQSPDFQSVTPKEKVTITCRASQNIGSELHWYQQKPDQSPKLLIKYASYSVSGVPSRFSGSGSGTDFTLTINGLEAEDAATYYCHQSISLPQTFGQGTKVDIK |
| J313M2S3#33 | 529 | EIVLTQSPDFQSVTPKEKVTITCRASQNIGSELHWYQQKPDQSPKLLIKYASHSTSGVPSRFSGSGSGTDFTLTINGLEAEDAATYYCHQSASLPITFGQGTKVDIK |
| J313M2S3#29 | 530 | EIVLTQSPDFQSVTPKEKVTITCRASQNIGSGLHWYQQKPDQSPKLLIKYASYSISGVPSRFSGSGSGTDFTLTINGLEAEDAGTYYCHQSAYLPYTFGPGTKVDIK |
| J313M2S3#81 | 531 | EIVLTQSPDFQSVTPKEKVTITCRASQNIGSELHWYQQKPDQSPKLLIKYASHSISGVPSRFSGSGSGTDFTLTINGLEAEDAGTYYCHQSAVLPDTFGPGTKVDIK |
| J313M2S3#31 | 532 | EIVLTQSPDFQSVAPKEKVTITCRASQNIGSELHWYQQKPDQSPKLLIKYASSSISGVPSRFSGSGSGTDFTLTINGLEAEDAGTYYCHQSSDLPYTFGPGTKVDIK |
| J313M2S3#72 | 533 | EIVLTQSPDFQSVTPKEKVTITCRASQNIDSELHWYQQKPDQSPKLLIKYASESISGVPSRFSGSGSGTDFALTINGLEAEDAGTYYCHQSFSLPYTFGPGTKVDIK |
| J313M2S3#75 | 534 | EIVLTQSPDFQSVTPKEKVTITCRASQNIDSELHWYQQKPDQSPKLLIKYASESISGVPSRFSGSGSGTDFTLTINGLEAEDAGTYYCHQSAFLPYTFGPGTKVDIK |
| J313M2S3#6 | 535 | EIVLTQSPDFQSVTPKEKVTITCRASQNIDSDLHWYQQKPDQSPKLLIKYASHSVSGVPSRFSGSGSGTDFTLTINGLEAEDAGTYYCHQSYSLPFNFGPGTKVDIK |
| J313M2S3#79 | 536 | EIVLTQSPDFQSVTPKEKVTITCRASQNIGSELHWYQQKPDQSPKLLIKYASHSVSGVPSRFSGSGSGTDFTLTINGLEAEDAGTYYCHQSYMLPYSFGPGTKVDIK |
| J313M2S3#82 | 537 | EIVLTQSPDFQSVTPKEKVTITCRASQNIGEELHWYQQKPDQSPKLLIKYASSSPSGVPSRFSGSGSGTDFTLTINGLEAEDAGTYYCHQSFSLPVTFGPGTKVDIK |
| J313M2S3#30 | 538 | EIVLTQSPDFQSVAPKEKVTITCRASQNIGSELHWYQQKPDQSPKLLIKYASHSVSGVPSRFSGSGSGTDFTLTINGLEAEDAGTYYCHQSISLPYTFGPGTKVDIK |
| J313M2S3#46 | 539 | EIVLTQSPDFQSVTPKEKVTITCRASQAIGSELHWYQQKPDQSPKLLIKYASYSVSGVPSRFSGSGSGTDFTLTINGLEAEDAGTYYCHQSASLPYTFGQGTKVDIK |

The sequences of the individual CDRs of the VH and VL regions of the affinity matured fully human IL-17 antibodies from IL17-TN-K7-B6 in the above tables can be aligned to provide consensus CDR sequences such as those in the table below.

TABLE 26

| CDR region | Sequence Identifier | $X_1$ | $X_2$ | $X_3$ | $X_4$ | $X_5$ | $X_6$ | $X_7$ | $X_8$ | $X_9$ | $X_{10}$ | $X_{11}$ | $X_{12}$ | $X_{13}$ | $X_{14}$ | $X_{15}$ | $X_{16}$ | $X_{17}$ |
|---|---|---|---|---|---|---|---|---|---|---|---|---|---|---|---|---|---|---|
| CDR-H1 | SEQ ID NO.: 540 | S,G,T,V,R | Y | G,D,V,S,A,C,I | I,F,T,Y,M,V | S,G,C,N,V,H | | | | | | | | | | | | |
| CDR-H2 | SEQ ID NO.: 541 | G | I,V | T | P,H,N,T,L,I,V,S,F | F,I,M,V,S,L | F,L | G,M,L,E,A | T,I,S,W,A,F,L,M,V,H | A,T,V,S,E,D,P,I,G,R | D,N,Y,S,T,V,I | Y | A | Q | K | F | Q | G,D |
| CDR-H3 | SEQ ID NO.: 542 | E,D,V | P,S,T | N,S,T | E,D,A | F | W | N | G | Y | Y,F | T,A,S,D,P,N,C,V | T | H,D,Q,N,L | D,H,Y,N | F,L,Y | D | Y,S,L,N,F,C,I,H,A,D |
| CDR-L1 | SEQ ID NO.: 543 | R,W | A,V | S | Q | N,D,E,A,I | I | G,D,E | S,Y,A,E,F,T,G | A,E,D,S,G | L | H | | | | | | |
| CDR-L2 | SEQ ID NO.: 544 | Y | A | S | H,Q,Y,E,N,S,W | S,P,C,T | I,V,T,N,A,M,L,G,S,F,P,Q | S,P | | | | | | | | | | |
| CDR-L3 | SEQ ID NO.: 545 | H | Q | S,T,G | T,D,A,Y,S,F,N,I,E,M | S,D,N,G,I,T,F,Y,W,C,E,R,V,L,M | L | P | H,Y,Q,F,I,V,D,N | T,S,A,I,N,L | | | | | | | | |

The sequence data for CDR-H1 of the VH regions of the affinity matured fully human IL-17 antibodies from IL17-TN-K7-B6 also revealed that the first amino acid ($X_1$ position) of CDR-H1 is preferably preceded by an amino acid selected from R, S, I, T, G, L, K, V, P, W, and H.

Considering the aligned CDRs from affinity matured human IL-17 antibodies (Tables 22 and 26) and from the isolated fully human IL-17 antibodies (Table 6) leads to a more comprehensive set of consensus CDR sequences. See, Summary of Invention, supra.

The following were converted into IgG for further characterization.

TABLE 27

| SEQ ID No: | Protein region | | Sequence 123456789012345678901234567890 |
|---|---|---|---|
| 546 | pJP243 B6.1 #5VH (B6-5VH) | | EVQLVQSGAEVKKPGESVKISCKASGGSFRS YGISWVRQAPGQGLEWMGGITHFFGITDYAQ KFQGRVTITADESTTTAYMELSGLTSDDTAV YYCAREPNDFWNGYYDTHDFDSWGQGTTVTV SS |
| | pJP243 B6.1 #5VH | CDR-H1 Residues 31-35 of SEQ ID NO.: 546 | SYGIS |
| | pJP243 B6.1 #5VH | CDR-H2 Residues 50-66 of SEQ ID NO.: 546 | GITHFFGITDYAQKFQG |
| | pJP243 B6.1 #5VH | CDR-H3 Residues 99-115 of SEQ ID NO.: 546 | EPNDFWNGYYDTHDFDS |
| 547 | pJP244 B6.1 #5VK (B6-5Vk) | | EIVLTQSPDFQSVTPKEKVTITCRASQNIGS ELHWYQQKPDQSPKLLIKYASHSISGVPSRF SGSGSGTDFTLTINGLEAEDAATYYCHQSDT LPHTFGQGTKVDIK |
| | pJP244 B6.1 #5VK | CDR-L1 Residues 24-34 of SEQ ID NO.: 547 | RASQNIGSELH |
| | pJP244 B6.1 #5VK | CDR-L2 Residues 50-56 of SEQ ID NO.: 547 | YASHSIS |
| | pJP244 B6.1 #5VK | CDR-L3 Residues 89-97 of SEQ ID NO.: 547 | HQSDTLPHT |
| 548 | pJP245 B6.1 #15VH (B6-15VH) | | EVQLVQSGAEVKKPGESLKISCKASGGSFSG YGTSWVRQAPGQGLEWMGGITHFFGAVDYAQ KFQGRVTITADESTTTAYMELSGLTSDDTAV YYCARDPNEFWNGYYATHDFDYWGQGTTVTV SS |
| | pJP245 B6.1 #15VH | CDR-H1 Residues 31-35 of SEQ ID NO.: 548 | GYGTS |
| | pJP245 B6.1 #15VH | CDR-H2 Residues 50-66 of SEQ ID NO.: 548 | GITHFFGAVDYAQKFQG |
| | pJP245 B6.1 #15VH | CDR-H3 Residues 99-115 of SEQ ID NO.: 548 | DPNEFWNGYYATHDFDY |
| 549 | pJP246 B6.1 #15Vk (B6-15Vk) | | EIVLTQSPDFQSVTPKEKVTITCRASQNIGA ELHWYQQKPDQSPKLLIKYASHSISGVPSRF SGSGSGTDFTLTINGLEAEDAGTYYCHQTDR LPYSFGPGTKVDIK |
| | pJP246 B6.1 #15Vk | CDR-L1 Residues 24-34 of SEQ ID NO.: 549 | RASQNIGAELH |
| | pJP246 B6.1 #15Vk | CDR-L2 Residues 50-56 of SEQ ID NO.: 549 | YASHSIS |
| | pJP246 B6.1 #15Vk | CDR-L3 Residues 89-97 of SEQ ID NO.: 549 | HQTDRLPYS |
| 550 | pJP247 B6.1 #16VH (B6-16VH) | | EVQLVQSGAEVKMPGSSLKISCKASGGSFRG YGISWVRQAPGQGLEWMGGITPFFGWADYAQ KFQGRVTITADESTTTAYMELSGLTSDDTAV YYCARDPNEFWNGYYDTHHFDYWGQGTTVTV SS |
| | pJP247 B6.1 #16VH | CDR-H1 Residues 31-35 of SEQ ID NO.: 550 | GYGIS |
| | pJP247 | CDR-H2 Residues 50-66 | GITPFFGWADYAQKFQG |

TABLE 27-continued

| SEQ ID No: | Protein region | | Sequence 123456789012345678901234567890 |
|---|---|---|---|
| | B6.1 #16VH pJP247 B6.1 #16VH | CDR-H3 Residues 99-115 of SEQ ID NO.: 550 | of SEQ ID NO.: 550 DPNEFWNGYYDTHHFDY |
| 551 | pJP248 B6.1 #16Vk (B6-16Vk) | | EIVLTQSPDFQSVTPKEKVTITCRASQDIGS ALHWYQQKPDQSPKLLIKYASHSVSGVPSRF SGSGSGTDFTLTINGLEAEDAGTYYCHQSDI LPHTFGPGTKVDIK |
| | pJP248 B6.1 #16Vk | CDR-L1 Residues 24-34 of SEQ ID NO.: 551 | RASQDIGSALH |
| | pJP248 B6.1 #16Vk | CDR-L2 Residues 50-56 of SEQ ID NO.: 551 | YASHSVS |
| | pJP248 B6.1 #16Vk | CDR-L3 Residues 89-97 of SEQ ID NO.: 551 | HQSDILPHT |
| 552 | pJP249 B6.1 #17VH (B6-17VH) | | EVQLVQSGAEVKKPGSSVKVSCKASGGSFGG YGIGWVRQAPGQGLEWMGGITPFFGFADYAQ KFQGRVTITADESTTTAYMELSGLTSDDTAV YYCARDPNEFWNGYYSTHDFDSWGQGTTVTV SS |
| | pJP247 B6.1 #16VH | CDR-H1 Residues 31-35 of SEQ ID NO.: 552 | GYGIG |
| | pJP247 B6.1 #16VH | CDR-H2 Residues 50-66 of SEQ ID NO.: 552 | GITPFFGFADYAQKFQG |
| | pJP247 B6.1 #16VH | CDR-H3 Residues 99-115 of SEQ ID NO.: 552 | DPNEFWNGYYSTHDFDS |
| 553 | pJP252 B6.1 #17Vk (B6-17Vk) | | EIVLTQSPDFQSVTPKEKVTITCRASQDIGS ELHWYQQKPDQPPKLLIKYASHSTSGVPSRF SGSGSGTDFTLTINGLEAEDAGTYYCHQTDS LPYTFGPGTKVDIK |
| | pJP252 B6.1 #17Vk | CDR-L1 Residues 24-34 of SEQ ID NO.: 553 | RASQDIGSELH |
| | pJP252 B6.1 #17Vk | CDR-L2 Residues 50-56 of SEQ ID NO.: 553 | YASHSTS |
| | pJP252 B6.1 #17Vk | CDR-L3 Residues 89-97 of SEQ ID NO.: 553 | HQTDSLPYT |
| 554 | pJP251 B6.1 #18VH (B6-18VH) | | EVQLVQSGAEVKKPGESLKVSCKASGGRFRT YGISWVRQAPGQGLEWMGGITNFFGWTDYAQ KFQGRVTITADESTTTAYMELSGLTSDDTAV YYCARVPNEFWNGYYATDYFDNWGQGTTVTV SS |
| | pJP251 B6.1 #18VH | CDR-H1 Residues 31-35 of SEQ ID NO.: 554 | TYGIS |
| | pJP251 B6.1 #18VH | CDR-H2 Residues 50-66 of SEQ ID NO.: 554 | GITNFFGWTDYAQKFQG |
| | pJP251 B6.1 #18VH | CDR-H3 Residues 99-115 of SEQ ID NO.: 554 | VPNEFWNGYYATDYFDN |
| 555 | pJP250 B6.1 #18Vk (B6-18Vk) | | EIVLTQSPDFQSVTPKEKVTITCRASQEIGA SLHWYQQKPDQSPKLLIKYASHSASGVPSRF SGSGSGTDFTLTINSLEAEDAATYYCHQSDG LPYTFGQGTKVDIK |
| | pJP250 B6.1 #18Vk | CDR-L1 Residues 24-34 of SEQ ID NO.: 555 | RASQEIGASLH |
| | pJP250 B6.1 #18Vk | CDR-L2 Residues 50-56 of SEQ ID NO.: 555 | YASHSAS |
| | pJP250 B6.1 #18Vk | CDR-L3 Residues 89-97 of SEQ ID NO.: 555 | HQSDGLPYT |

TABLE 27-continued

| SEQ ID No: | Protein region | | Sequence 123456789012345678901234567890 |
|---|---|---|---|
| 556 | pJP253 B6.1 #46VH (B6-46VH) | | EVQLVQSGAEVKKPGESLKISCKASGGSFIS YGISWVRQAPGQGLEWMGGITHFFGSTDYAQ KFQGRVTITADESTTTAYMELSGLTSDDTAV YYCAREPNEFWNGYYTTHDFDSWGQGTTVTV SS |
| | pJP253 B6.1 #46VH | CDR-H1 Residues 31-35 of SEQ ID NO.: 556 | SYGIS |
| | pJP253 B6.1 #46VH | CDR-H2 Residues 50-66 of SEQ ID NO.: 556 | GITHFFGSTDYAQKFQG |
| | pJP253 B6.1 #46VH | CDR-H3 Residues 99-115 of SEQ ID NO.: 556 | EPNEFWNGYYTTHDFDS |
| 557 | pJP254 B6.1 #46Vk (B6-46Vk) | | EIVLTQSPDFQSVTPKEKVTITCRASQAIGS ELHWYQQKPDQSPKLLIKYASYSVSGVPSRF SGSGSGTDFTLTINGLEAEDAGTYYCHQSAS LPYTFGQGTKVDIK |
| | pJP254 B6.1 #46Vk | CDR-L1 Residues 24-34 of SEQ ID NO.: 557 | RASQAIGSELH |
| | pJP254 B6.1 #46Vk | CDR-L2 Residues 50-56 of SEQ ID NO.: 557 | YASYSVS |
| | pJP254 B6.1 #46Vk | CDR-L3 Residues 89-97 of SEQ ID NO.: 557 | HQSASLPYT |
| 558 | pJP255 B6.1 #44VH (B6-44VH) | | EVQLVQSGAEVKKPGSSVKVSCKASGGSFLS YGFSWVRQAPGQGLEWMGGITPFFGLADYAQ KFQGRVTITADESTTTAYMELSGLTSDDTAV YYCARESSEFWNGYYCTQDFDLWGQGTTVTV SS |
| | pJP255 B6.1 #44VH | CDR-H1 Residues 31-35 of SEQ ID NO.: 558 | SYGFS |
| | pJP255 B6.1 #44VH | CDR-H2 Residues 50-66 of SEQ ID NO.: 558 | GITPFFGLADYAQKFQG |
| | pJP255 B6.1 #44VH | CDR-H3 Residues 99-115 of SEQ ID NO.: 559 | ESSEFWNGYYCTQDFDL |
| 559 | pJP256 B6.1 #44Vk (B6-44Vk) | | EIVLTQSPDFQSVTPKEKVTITCRASQDIGS DLHWYQQKPDQSPKLLIKYASNSISGVPSRF SGSGSGTDFTLTINGLEAEDAGTYYCHQTAY LPQTFGPGTKVDIK |
| | pJP256 B6.1 #44Vk | CDR-L1 Residues 24-34 of SEQ ID NO.: 559 | RASQDIGSDLH |
| | pJP256 B6.1 #44Vk | CDR-L2 Residues 50-56 of SEQ ID NO.: 559 | YASNSIS |
| | pJP256 B6.1 #44Vk | CDR-L3 Residues 89-97 of SEQ ID NO.: 559 | HQTAYLPQT |
| 560 | B6.11 VH (pairs with parental VL, SEQ ID NO: 47) | | EVQLVQSGAEVKKPGSSVKVSCKASGGSFLS YGFSWVRQAPGQGLEWMGGITPFFGFADYAQ KFQGRVTITADESTTTAYMELSGLTSDDTAV YYCAREPNDFWNGYYTTHHFDYWGQGTTVTV SS |
| | B6.11 VH | CDR-H1 Residues 31-35 of SEQ ID NO.: 560 | SYGFS |
| | B6.11 VH | CDR-H2 Residues 50-66 of SEQ ID NO.: 560 | GITPFFGFADYAQKFQG |
| | B6.11 VH | CDR-H3 Residues 99-115 of SEQ ID NO.: 560 | EPNDFWNGYYTTHHFDY |
| 561 | B6.29 VH (pairs | | EVQLVQSGAEVKKPGSSVKVSCKASGGSFIS YGYNWVRQAPGQGLEWMGGITPFFGTADYAQ |

TABLE 27-continued

| SEQ ID No: | Protein region | | Sequence 12345678901234567890123456 7890 |
|---|---|---|---|
| | with parental VL, SEQ ID NO: 47) | | KFQGRVTITADESTTTAYMELSGLTSDDTAV YYCAREPNDFWNGYYTTHHFDYWGQGTTVTV SS |
| | B6.29 VH | CDR-H1 Residues 31-35 of SEQ ID NO.: 561 | SYGYN |
| | B6.29 VH | CDR-H2 Residues 50-66 of SEQ ID NO.: 561 | GITPFFGTADYAQKFQG |
| | B6.29 VH | CDR-H3 Residues 99-115 of SEQ ID NO.: 561 | EPNDFWNGYYTTHHFDY |

2.2: Functional Characterization of Human IL-17 Antibodies
2.2.1: IL-17 Enzyme-Linked Immunosorbent Assay Protocol IL-17 binding by the human antibodies was assessed by ELISA (assay described above, Example 1.5.1). Results are shown in the table below.

TABLE 28

Binding of human antibodies to human IL-17 by ELISA

| MAb | EC50 in hIL-17 ELISA (pM) |
|---|---|
| IL-17-TN-K7-B6 | 447 |
| IL-17-TN-L7-C8 | 517 |
| IL-17-TN-L7-A7 | 131 |
| IL-17-TN-L7-G9 | 165 |
| IL-17-LN-K9-F5 | 7445 |
| IL17-G9-1 | 130 |
| IL17-G9-2 | 180 |
| IL17-G9-3 | 50 |
| IL17-G9-4 | 60 |
| IL17-G9-5 | 120 |
| IL17-G9-6 | 120 |
| IL17-G9-M1 | 80 |
| IL17-G9-M2 | 80 |
| IL17-B6-5 | 220 |
| IL17-B6-15 | 130 |
| IL17-B6-16 | 160 |
| IL17-B6-17 | 130 |
| IL17-B6-18 | 160 |
| IL17-B6-46 | 140 |
| IL17-B6-11 | 58 |
| IL17-B6-29 | 90 |

2.2.2: Neutralizing Potency of Human IL-17 Antibodies

Potency of several fully human antibodies identified by PROfusion mRNA display technology from human antibody libraries was assessed using the IL-17-driven IL-6 production in HS27 cells (assay described above, Example 1.5.2). The table below summarizes potencies to human IL-17A. It should be noted that the final concentration of human IL-17A in these assays was 0.3 nM.

TABLE 29

| | Potency (nM) | | |
|---|---|---|---|
| Anti-IL-17 MAb | Hu IL-17A | Hu IL-17A/F | Cyno IL-17A |
| A7 | 1.8 | 1.8 | 12 |
| B6 | 4.5 | 8.1 | 18 |
| C8 | 4.5 | 2.6 | 18 |
| G9 | 0.8 | 2.0 | 12 |

2.2.3: Neutralizing Potency of Affinity Matured Human Antibodies

Potency of fully human antibodies derived from affinity maturation of IL17-TN-L7-G9 and IL17-TN-K7-B6 was assessed using IL-17-driven IL-6 production in HS27 cells for human and cyno antigens (assay described above, Example 1.5.2). For murine, rat, or rabbit IL-17A neutralization assay the IL-17 and TNF-induced IL-6 secretion from murine embryonic fibroblast cell line NIH3T3 was used (assay described above, Example 1.5.3). The table below summarizes the neutralizing potencies.

TABLE 30

| | Potency (pM) | | | | | |
|---|---|---|---|---|---|---|
| Anti-IL-17 MAb | Hu IL-17A | Hu IL-17A/F | Cyno IL-17A | Rat IL-17A | Mouse IL-17A | Rabbit IL-17A |
| B6-5 | 18 | 134 | 12 | 73 | 64 | 320 |
| B6-11 | 20 | 71 | 33 | 6100 | NI | ND |
| B6-15 | 24 | 162 | 10 | 17 | ND | ND |
| B6-16 | 26 | 114 | 13 | 167 | ND | ND |
| B6-17 | 15 | 137 | 11 | 111 | 69 | 232 |
| B6-29 | 134 | ND | ND | ND | ND | ND |
| B6-44 | 120 | 288 | 65 | ND | ND | ND |
| B6-46 | 59 | ND | ND | ND | ND | ND |
| G9-1 | 27 | 99 | 604 | NI | NI | ND |
| G9-2 | 24 | 147 | 157 | NI | NI | NI |
| G9-3 | 334 | ND | ND | ND | ND | ND |
| G9-4 | 38 | 119 | 247 | NI | NI | ND |
| G9-5 | 310 | ND | ND | ND | ND | ND |
| G9-6 | 884 | ND | ND | ND | ND | ND |
| G9-M1 | 88 | ND | ND | NI | NI | ND |
| G9-M2 | 38 | 44 | 105 | NI | NI | ND |

NI: no inhibition.
ND: not determined 2.2.3: Affinity Measurement of IL-17 Antibodies by Surface Plasmon Resonance The binding of human anti-IL-17 antibodies to purified recombinant human (HuIL-17A), cyno (Cyno IL-17A), rat (RatIL-17A), mouse (MuIL-17A), rabbit IL-17 (RabIL-17A), and human IL-17A/F (HuIL-17A/F) was determined by surface plasmon resonance-based measurements with a Biacore® 3000 instrument (Biacore® AB, Uppsala, Sweden) using running HBS-EP (10 mM HEPES [pH 7.4], 150 mM NaCl, 3 mM EDTA, and 0.005% surfactant P20) at 25° C. as described above (Example 1.5.4). The table below shows the affinity measurements for selected human anti-human IL-17A antibodies.

TABLE 31

Affinity measure of anti-human IL-17 antibodies.

| Human antibody | IL-17 Antigen | | | | | |
|---|---|---|---|---|---|---|
| | HuIL-17A | HuIL-17A/F | Cyno IL-17A | RatIL-17A | MuIL-17A | RabIL-17A |
| G9 (M) | 2.80E−10 | 9.07E−10 | 2.07E−09 | ND | ND | ND |
| Kon (1/Ms) | 3.09E+05 | 1.07E+05 | 9.60E+04 | | | |
| Koff (1/s) | 8.65E−05 | 9.70E−05 | 1.99E−04 | | | |
| G9-1 (M) | 2.57E−11 | 3.13E−12 | 2.96E−12 | ND | ND | ND |
| Kon (1/Ms) | 4.08E+05 | 3.20E+05 | 3.38E+05 | | | |
| Koff (1/s) | 1.05E−05 | 1.00E−06 | 1.00E−06 | | | |
| G9-2 (M) | <4.33E−12 | 4.37E−10 | <2.70E−12 | ND | ND | ND |
| Kon (1/Ms) | 2.31E+05 | 1.98E+05 | 3.71E+05 | | | |
| Koff (1/s) | <1.00E−6 | 8.66E−05 | <1.00E−6 | | | |
| G9-4 (M) | 4.69E−12 | 4.24E−12 | 3.77E−12 | ND | ND | ND |
| Kon (1/Ms) | 2.13E+05 | 2.36E+05 | 2.65E+05 | | | |
| Koff (1/s) | 1.00E−06 | 1.00E−06 | 1.00E−06 | | | |
| G9-M1 (M) | 3.22E−12 | 2.44E−10 | 2.65E−12 | ND | ND | ND |
| Kon (1/Ms) | 3.11E+05 | 1.62E+05 | 3.77E+05 | | | |
| Koff (1/s) | 1.00E−06 | 3.95E−05 | 1.00E−06 | | | |
| G9-M2 (M) | 8.26E−12 | 1.03E−11 | <2.45E−12 | ND | ND | ND |
| Kon (1/Ms) | 2.81E+05 | 1.37E+05 | 4.08E+05 | | | |
| Koff (1/s) | 2.32E−06 | 1.41E−06 | <1.00E−6 | | | |
| B6 (M) | 8.40E−10 | 2.19E−08 | 9.92E−10 | ND | ND | ND |
| Kon (1/Ms) | 1.75E+04 | 7.98E+03 | 2.53E+04 | | | |
| Koff (1/s) | 1.47E−05 | 1.75E−04 | 2.51E−05 | | | |
| B6-5 (M) | 3.18E−12 | 2.22E−12 | 5.39E−12 | 9.05E−12 | 3.95E−11 | 3.17E−12 |
| Kon (1/Ms) | 7.20E+06 | 1.33E+07 | 1.21E+07 | 6.12E+06 | 2.58E+06 | 7.03E+06 |
| Koff (1/s) | 2.29E−05 | 2.95E−05 | 6.52E−05 | 5.54E−05 | 1.02E−04 | 2.23E−05 |
| B6-15 (M) | 7.30E−12 | 6.47E−12 | 4.01E−12 | ND | ND | ND |
| Kon (1/Ms) | 8.25E+06 | 8.82E+06 | 1.37E+07 | | | |
| Koff (1/s) | 6.02E−05 | 5.71E−05 | 5.50E−05 | | | |
| B6-16 (M) | 7.94E−12 | 1.64E−11 | 4.83E−12 | ND | ND | ND |
| Kon (1/Ms) | 3.78E+06 | 4.00E+06 | 9.27E+06 | | | |
| Koff (1/s) | 3.00E−05 | 6.57E−05 | 4.48E−05 | | | |
| B6-17 (M) | 7.85E−13 | 1.70E−12 | 1.03E−12 | 9.64E−12 | 1.13E−10 | 3.51E−12 |
| Kon (1/Ms) | 3.95E+06 | 7.23E+06 | 1.02E+07 | 6.13E+06 | 1.49E+06 | 9.58E+06 |
| Koff (1/s) | 3.10E−06 | 1.23E−05 | 1.05E−05 | 5.91E−05 | 1.69E−04 | 3.36E−05 |

ND: Not determined.

2.2.4: Pharmacokinetic Analysis of IL-17 Antibodies in Rat

Pharmacokinetic studies of human anti-human IL-17 antibodies were carried out in Sprague Dawley rats. Male rats were dosed intravenously with a single dose of 4 mg/kg of antibody proteins and serum samples were analyzed using antigen capture based chemiluminescent MSD (Meso Scale Discovery) method. Pharmacokinetic parameters were calculated by non-compartmental analysis using WinNonlin.

2.2.4.1: Preparation of Rat Serum

Surgically altered (jugular vein cannulated, JVC) and regular male Sprague-Dawley Rats (approximately seven weeks old, weighing 240-390 grams) were purchased from Charles River Laboratories (Wilmington, Mass.). The animals were housed in rooms maintained at constant temperature and humidity under 12 h light/dark cycle, fed with normal rodent chow and were allowed food and water ad libitum. Hydration and clinical conditions of the animals were monitored daily.

Blood samples were collected (0.2 mL) at various time-points, allowed to clot for 30 minutes at room temperature, and centrifuged for 8 minutes at 13,200 rpm. Then, serum was transferred to eppendorf tubes and stored frozen at −80° C.

2.2.4.2: MSD Assay Used to Quantify IL-17 Antibody in PK Serum Samples

MSD streptavidin plates (Meso Scale Discovery) were washed with phosphate buffered saline containing 0.05% Tween-20 (diluted from 10×PBS, Abbott Bioresearch Center, Media Room, Worcester, Mass. and Tween-20, Sigma, St. Louis, Mo.). Plates were blocked with 150 μL/well blocking solution (MSD Block, Meso Scale Discovery, diluted to 3% final concentration in PBS) for 1 hour, covered, with shaking (600 rpm) at room temperature.

Prior to analysis, rat serum samples were thawed on ice, mixed gently, and centrifuged at 14,000 rpm for 3 minutes at 4° C. in an eppendorf centrifuge. Standard curve and control samples were prepared in rat serum. Study samples, standard curve samples, blanks, and quality control samples were incubated in solution in a separate 2 mL deep well 96-well plate (Corning, Corning, N.Y.) 1:1:1=V:V:V with biotinylated human IL-17 (0.1 ug/mL in assay buffer) and sulfo-tagged goat anti-human IgG (Meso Scale Discovery, 1 μg/mL in assay buffer) for 1 hour at room temperature. The samples were then transferred to the MSD plates and incubated for an additional hour with shaking (600 rpm) at room temperature. The MSD plates were washed and developed with 2× Read Buffer (Meso Scale Discovery). Chemiluminiscence was measured within ten minutes on the MSD Sector Imager 6000.

Standard curves were analyzed using four-parameter logistic fit and sample concentrations were calculated by XLfit4 software version 2.2.1 Build 16, (Microsoft Corporation, Redmond, Wash.). Pharmacokinetic parameters were calculated for each animal using Winonlin software version 5.0.1 (Pharsight Corporation, Mountain View, Calif.) by noncompartmental analysis.

The pharmacokinetic profile for selected human anti-human IL-17A antibodies is shown in the table below.

TABLE 32

Pharmacokinetic profile of human IL-17 antibodies.

| mAb | T½ (day) | Vss (mL/kg) | Cl (ml/hr/kg) |
|---|---|---|---|
| IL-17-B6-17 | 11.9 | 66 | 0.18 |
| IL17-B6-5 | 11.8 | 68 | 0.18 |
| IL-17-G9-2 | 11.1 | 130 | 0.37 |

2.3: Therapeutic Efficacy of IL-17 Antibodies 2.3.1: Neutralizing Potency of IL-17 Antibodies in Acute IL-17 Induced KC Model Two of the fully human antibodies to human IL-17 were evaluated in the acute in vivo rhIL17-induced KC model. Female BALB/cJ mice were pre-dosed with antibodies intraperitoneally (i.p.), and 18 hrs later they were injected i.p. with 3 μg rhIL17 in a 500 μL volume. After 1 hour, the mice were sacrificed, and the levels of KC were assessed by MesoScale. ED50 values for % inhibition of KC were determined. As shown in Table W, Both B6-5 and B6-17 fully neutralized IL-17 induced KC production with ED50s of 7.5 and 17.1 mg/kg respectively.

TABLE 33

ED50 of anti-IL-17 antibodies in recombinant human IL-17 induced KC model.

| Anti-IL-17 MAb | ED50 (mg/kg) |
|---|---|
| B6-5 | 7.5 |
| B6-17 | 17.1 |

Example 3

Generation of TNF/IL-17 DVD-Ig™ Molecules 3.1: Construction of TNF/IL-17 DVD-Ig DNA Constructs Anti-TNF antibody variable domains (D2E7) are combined with multiple IL-17 antibody variable domains by overlapping PCR amplification with intervening linker DNA sequences. The amplified PCR products are subcloned into expression vectors suitable for transient expression in HEK293 cells and the open reading frame regions are confirmed by sequencing before DVD-Ig expression.

3.2: Expression and Production of TNF/IL17 DVD-Ig Binding Proteins

After DNA confirmation by sequencing, all DVD-Ig DNA constructs were expanded in E. coli and DNA are purified using Qiagen Hispeed Maxi Prep (CAT#12662, QIAGEN). DVD-Ig DNA was transfected into log phase 293E cells ($0.5 \times 10^6$/ml, viability >95%) by mixing PEI and DNA @ 2:1 ratio with 0.2 μg/ml heavy chain DNA and 0.3 μg/ml light chain DNA. DNA:PEI complex was formed at room temperature in TC hood for fifteen minutes before adding to 293E cells. Twenty four later, 0.5% TN1 was added to 293E cells. At day five, supernatant was collected for human IgG1 titer measurement. Cell supernatant was harvested at day seven and filtered through 0.2 μM PES filter. Supernatant was purified by using Protein A Sepharose Affinity Chromatography according to manufacturer's instruction. Purified DVD-Igs were eluted off the column by 0.1 M glycine (pH 2.99) and dialyzed into 15 mM histidine buffer (pH 6.0) immediately. The binding proteins were quantitated by A280 and analyzed by mass spectrometry and SEC.

3.3: Sequences of TNF/IL-17 DVD-Ig Constructs

Amino acid sequence of heavy chain and light chain of DVD-Ig proteins capable of binding human TNF and hIL-17 were determined. The amino acid sequences of variable heavy chains, variable light chains, and constant regions of TNF/IL-17 DVD-Ig binding proteins are shown in the table below.

TABLE 34

Sequences of variable and constant regions of TNF/IL-17 DVD-Ig binding proteins.

| Protein Protein region | Sequence Identifier | Sequence 12345678901234567890 |
|---|---|---|
| DVD HEAVY VARIABLE D2-GS6-B6 DVD | SEQ ID NO.: 562 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGEVQLVQSGAEVKK PGESLKISCKASGGSFRSYG ISWVRQAPGQGLEWMGGITP ILGTANYAQKFQGRVTITAD ESTTTAYMELSGLTSDDTAV YYCAREPNDFWNGYYTTHHF DYWGQGTPVTVSS |
| D2 VH | SEQ ID NO.: 563 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 564 | GGGGSG |
| B6-VH | SEQ ID NO.: 565 | EVQLVQSGAEVKKPGESLKI SCKASGGSFRSYGISWVRQA PGQGLEWMGGITPILGTANY |

TABLE 34-continued

Sequences of variable and constant regions of TNF/IL-17 DVD-Ig binding proteins.

| Protein Protein region | Sequence Identifier | Sequence |
|---|---|---|
| | | AQKFQGRVTITADESTTTAY MELSGLTSDDTAVYYCAREP NDFWNGYYTTHHFDYWGQGT PVTVSS |
| CH | SEQ ID NO.: 566 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-B6 DVD | SEQ ID NO.: 567 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIK<u>RGGSGG</u>DVVMTQS PDFQSVTPKEKVTITCRASQ NIGSALHWYQQKPDQSPKLL IKYASQSISGVPSRFSGSGS GTDFTLTINGLEAEDAGTYY CHQSTSLPHTFGQGTKLDIK R |
| E7 VL | SEQ ID NO.: 568 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 569 | GGSGG |
| B6 VL | SEQ ID NO.: 570 | DVVMTQSPDFQSVTPKEKVT ITCRASQNIGSALHWYQQKP DQSPKLLIKYASQSISGVPS RFSGSGSGTDFTLTINGLEA EDAGTYYCHQSTSLPHTFGQ GTKLDIKR |
| CL | SEQ ID NO.: 571 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-SL-B6 DVD | SEQ ID NO.: 572 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S<u>ASTKGP</u>EVQLVQSGAEVKK PGESLKISCKASGGSFRSYG ISWVRQAPGQGLEWMGGITP ILGTANYAQKFQGRVTITAD ESTTTAYMELSGLTSDDTAV YYCAREPNDFWNGYYTTHHF DYWGQGTPVTVSS |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| D2 VH | SEQ ID NO.: 573 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| LINKER | SEQ ID NO.: 574 | ASTKGP |
| B6-VH | SEQ ID NO.: 575 | EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYTTHHFDYWGQGTPVTVSS |
| CH | SEQ ID NO.: 576 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD HEAVY VARIABLE D2-GS6-G9-DVD | SEQ ID NO.: 577 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEEVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| D2 VH | SEQ ID NO.: 578 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| LINKER | SEQ ID NO.: 579 | GGGGSG |
| G9 VH | SEQ ID NO.: 580 | EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| CH | SEQ ID NO.: 581 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP |

TABLE 34-continued

Sequences of variable and constant regions of TNF/IL-17 DVD-Ig binding proteins.

| Protein Protein region | Sequence Identifier | Sequence |
|---|---|---|
| | | KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS6-G9 DVD | SEQ ID NO.: 582 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR<u>GGSGG</u>QSVLTQP PSASGTPGQTVSISCSGSNS NIGSHSVNWYQQVPGAAPKL LMYGIGQRPSGVPDRFSVSQ SGTSASLAISGLQSEDEADY YCATWDDSLGGYVFGSGTKV TVLGQPKAAPSVTLFPPSSE ELQANKATLVCLISDFYPGA VTVAWKADSSPVKAGVETTT PSKQSNNKYAASSYLSLTPE QWKSHRSYSCQVTHEGSTVE KTVAPTECS |
| E7 VL | SEQ ID NO.: 583 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 584 | GGSGG |
| G9 VL | SEQ ID NO.: 585 | QSVLTQPPSASGTPGQTVSI SCSGSNSNIGSHSVNWYQQV PGAAPKLLMYGIGQRPSGVP DRFSVSQSGTSASLAISGLQ SEDEADYYCATWDDSLGGYV FGSGTKVTVLG |
| CL | SEQ ID NO.: 586 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD LIGHT VARIABLE E7-SL-G9 DVD | SEQ ID NO.: 587 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR<u>TVAAP</u>QSVLTQP PSASGTPGQTVSISCSGSNS NIGSHSVNWYQQVPGAAPKL LMYGIGQRPSGVPDRFSVSQ SGTSASLAISGLQSEDEADY YCATWDDSLGGYVFGSGTKV TVLG |
| E7 VL | SEQ ID NO.: 588 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| LINKER | SEQ ID NO.: 589 | TVAAP |
| G9 VL | SEQ ID NO.: 590 | QSVLTQPPSASGTPGQTVSI SCSGSNSNIGSHSVNWYQQV PGAAPKLLMYGIGQRPSGVP DRFSVSQSGTSASLAISGLQ SEDEADYYCATWDDSLGGYV FGSGTKVTVLG |
| CL | SEQ ID NO.: 591 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-SL-G9 DVD | SEQ ID NO.: 592 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SASTKGPEVQLLESGGGVVQ PGRSLRLSCAASGFIFSNYG MHWVRQAPGKGLEWVAVISY DGSNKYYADSVKGRFTISRD NSKNTLYLEMNSLRPEDTAV YYCAKVGASGDYYYSYGLDV WGQGTTVTVSS |
| D2 VH | SEQ ID NO.: 593 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 594 | ASTKGP |
| G9 VH | SEQ ID NO.: 595 | EVQLLESGGGVVQPGRSLRL SCAASGFIFSNYGMHWVRQA PGKGLEWVAVISYDGSNKYY ADSVKGRFTISRDNSKNTLY LEMNSLRPEDTAVYYCAKVG ASGDYYYSYGLDVWGQGTTV TVSS |
| CH | SEQ ID NO.: 596 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS6-G9-1 DVD | SEQ ID NO.: 597 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGSGGQSVLTQP PSASGTPGQTVSISCSGSHS NIGRHPVDWYQQVPGAAPKL |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| | | LMYYGGYRPSGVPDRFSGSQ<br>SGTSASLAISGLQSEDEADY<br>YCATWDDRLVGYVFGSGTKV<br>TVLG |
| E7 VL | SEQ ID NO.: 598 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 599 | GGSGG |
| G9-1 VL | SEQ ID NO.: 600 | QSVLTQPPSASGTPGQTVSI<br>SCSGSHSNIGRHPVDWYQQV<br>PGAAPKLLMYYGGYRPSGVP<br>DRFSGSQSGTSASLAISGLQ<br>SEDEADYYCATWDDRLVGYV<br>FGSGTKVTVLG |
| CL | SEQ ID NO.: 601 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD LIGHT<br>VARIABLE<br>E7-SL-G9-1 DVD | SEQ ID NO.: 602 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR<u>TVAAP</u>QSVLTQP<br>PSASGTPGQTVSISCSGSHS<br>NIGRHPVDWYQQVPGAAPKL<br>LMYYGGYRPSGVPDRFSGSQ<br>SGTSASLAISGLQSEDEADY<br>YCATWDDRLVGYVFGSGTKV<br>TVLG |
| E7 VL | SEQ ID NO.: 603 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 604 | TVAAP |
| G9-1 VL | SEQ ID NO.: 605 | QSVLTQPPSASGTPGQTVS<br>ISCSGSHSNIGRHPVDWYQ<br>QVPGAAPKLLMYYGGYRPS<br>GVPDRFSGSQSGTSASLAI<br>SGLQSEDEADYYCATWDDR<br>LVGYVFGSGTKVTVLG |
| CL | SEQ ID NO.: 606 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD LIGHT<br>VARIABLE<br>E7-GS6-G9-4 DVD | SEQ ID NO.: 607 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR<u>GGSGGG</u>QSVLTQP<br>PSASGTPGQTVSISCSGRQS<br>NIGRHYVDWYQQVPGAAPKL<br>LMYYDSIRPSGVPDRFSGSQ<br>SGTSASLAISGLQSEDEADY |

TABLE 34-continued

Sequences of variable and constant regions of TNF/IL-17 DVD-Ig binding proteins.

| Protein Protein region | Sequence Identifier | Sequence |
|---|---|---|
| | | YCATWDDSLGGYVFGSGTKV TVLG |
| E7 VL | SEQ ID NO.: 608 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 609 | GGSGG |
| G9-4 VL | SEQ ID NO.: 610 | QSVLTQPPSASGTPGQTVSI SCSGRQSNIGRHYVDWYQQV PGAAPKLLMYYDSIRPSGVP DRFSGSQSGTSASLAISGLQ SEDEADYYCATWDDSLGGYV FGSGTKVTVLG |
| CL | SEQ ID NO.: 611 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD LIGHT VARIABLE E7-SL-G9-4 DVD | SEQ ID NO.: 612 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRTVAAPQSVLTQP PSASGTPGQTVSISCSGRQS NIGRHYVDWYQQVPGAAPKL LMYYDSIRPSGVPDRFSGSQ SGTSASLAISGLQSEDEADY YCATWDDSLGGYVFGSGTKV TVLG |
| E7 VL | SEQ ID NO.: 613 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 614 | TVAAP |
| G9-4 VL | SEQ ID NO.: 615 | QSVLTQPPSASGTPGQTVSI SCSGRQSNIGRHYVDWYQQV PGAAPKLLMYYDSIRPSGVP DRFSGSQSGTSASLAISGLQ SEDEADYYCATWDDSLGGYV FGSGTKVTVLG |
| CL | SEQ ID NO.: 616 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD LIGHT VARIABLE E7-GS6-G9-M2 DVD | SEQ ID NO.: 617 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGGSGGQSVLTQP PSASGTPGQTVSISCSGHNS NIGYHYVHWYQQVPGAAPKL LIYGDGWRPSGVPDRFSGSQ SGTSASLAISGLQSEDEADY YCGTWDDWLGGYVFGTGTKV TVLG |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| E7 VL | SEQ ID NO.: 618 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 619 | GGSGG |
| G9-M2 VL | SEQ ID NO.: 620 | QSVLTQPPSASGTPGQTVSI<br>SCSGHNSNIGYHYVHWYQQV<br>PGAAPKLLIYGDGWRPSGVP<br>DRFSGSQSGTSASLAISGLQ<br>SEDEADYYCGTWDDWLGGYV<br>FGTGTKVTVLG |
| CL | SEQ ID NO.: 621 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD LIGHT<br>VARIABLE<br>E7-SL-G9-M2 DVD | SEQ ID NO.: 622 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKRTVAAPQSVLTQP<br>PSASGTPGQTVSISCSGHNS<br>NIGYHYVHWYQQVPGAAPKL<br>LIYGDGWRPSGVPDRFSGSQ<br>SGTSASLAISGLQSEDEADY<br>YCGTWDDWLGGYVFGTGTKV<br>TVLG |
| E7 VL | SEQ ID NO.: 623 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 624 | TVAAP |
| G9-M2 VL | SEQ ID NO.: 625 | QSVLTQPPSASGTPGQTVSI<br>SCSGHNSNIGYHYVHWYQQV<br>PGAAPKLLIYGDGWRPSGVP<br>DRFSGSQSGTSASLAISGLQ<br>SEDEADYYCGTWDDWLGGYV<br>FGTGTKVTVLG |
| CL | SEQ ID NO.: 626 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>D2-GS10-G9-2 DVD | SEQ ID NO.: 627 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGGGGSEVQLLESGG<br>GVVQPGRSLRLSCAASGFIF<br>RNYGMHWVRQAPGKGLEWVA<br>VISYDGSNKYYADSVKGRFT<br>ISRDNSKNTLYLEMNSLRPE<br>DTAVYYCAKVGASGDYYYSY<br>GLDVWGQGTTVTVSS |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| D2 VH | SEQ ID NO.: 628 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 629 | GGGGSGGGGS |
| G9-2 VH | SEQ ID NO.: 630 | EVQLLESGGGVVQPGRSLRL<br>SCAASGFIFRNYGMHWVRQA<br>PGKGLEWVAVISYDGSNKYY<br>ADSVKGRFTISRDNSKNTLY<br>LEMNSLRPEDTAVYYCAKVG<br>ASGDYYYSYGLDVWGQGTTV<br>TVSS |
| CH | SEQ ID NO.: 631 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT VARIABLE<br>E7-GS10-G9-2 DVD | SEQ ID NO.: 632 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKRGGSGGGGSGSQS<br>VLTQPPSASGTPGQTVSISC<br>SGSNSNIGRHPVDWYQQVPG<br>AAPKLLIYYDDQRPSGVPDR<br>FSGSQSGTSASLAISGLQSE<br>DEADYYCATWDDSLGGYVFG<br>SGTKVTVLG |
| E7 VL | SEQ ID NO.: 633 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 634 | GGSGGGGSGS |
| G9-2 VL | SEQ ID NO.: 635 | QSVLTQPPSASGTPGQTVSI<br>SCSGSNSNIGRHPVDWYQQV<br>PGAAPKLLIYYDDQRPSGVP<br>DRFSGSQSGTSASLAISGLQ<br>SEDEADYYCATWDDSLGGYV<br>FGSGTKVTVLG |
| CL | SEQ ID NO.: 636 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY VARIABLE | SEQ ID NO.: 637 | EVQLVESGGGLVQPGRSLRL<br>SCAASGFTFDDYAMHWVRQA |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| D2-GS6-G9-2 DVD | | PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGEVQLLESGGGVVQ<br>PGRSLRLSCAASGFIFRNYG<br>MHWVRQAPGKGLEWVAVISY<br>DGSNKYYADSVKGRFTISRD<br>NSKNTLYLEMNSLRPEDTAV<br>YYCAKVGASGDYYYSYGLDV<br>WGQGTTVTVSS |
| D2 VH | SEQ ID NO.: 638 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 639 | GGGGSG |
| G9-2 VH | SEQ ID NO.: 640 | EVQLLESGGGVVQPGRSLRL<br>SCAASGFIFRNYGMHWVRQA<br>PGKGLEWVAVISYDGSNKYY<br>ADSVKGRFTISRDNSKNTLY<br>LEMNSLRPEDTAVYYCAKVG<br>ASGDYYYSYGLDVWGQGTTV<br>TVSS |
| CH | SEQ ID NO.: 641 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT<br>VARIABLE<br>E7-GS6-G9-2 DVD | SEQ ID NO.: 642 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKRGGSGGQSVLTQP<br>PSASGTPGQTVSISCSGSNS<br>NIGRHPVDWYQQVPGAAPKL<br>LIYYDDQRPSGVPDRFSGSQ<br>SGTSASLAISGLQSEDEADY<br>YCATWDDSLGGYVFGSGTKV<br>TVLG |
| E7 VL | SEQ ID NO.: 643 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 644 | GGSGG |
| G9-2 VL | SEQ ID NO.: 645 | QSVLTQPPSASGTPGQTVSI<br>SCSGSNSNIGRHPVDWYQQV<br>PGAAPKLLIYYDDQRPSGVP<br>DRFSGSQSGTSASLAISGLQ |

TABLE 34-continued

Sequences of variable and constant regions of TNF/IL-17 DVD-Ig binding proteins.

| Protein Protein region | Sequence Identifier | Sequence |
|---|---|---|
| | | SEDEADYYCATWDDSLGGYVFGSGTKVTVLG |
| CL | SEQ ID NO.: 646 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-GS14-G9-2 DVD | SEQ ID NO.: 647 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGEVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| D2 VH | SEQ ID NO.: 648 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| LINKER | SEQ ID NO.: 649 | GGGGSGGGGSGGGG |
| G9-2 VH | SEQ ID NO.: 650 | EVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS |
| CH | SEQ ID NO.: 651 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-GS14-G9-2 DVD | SEQ ID NO.: 652 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGSGGGGSGGGGSQSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG |

TABLE 34-continued

Sequences of variable and constant regions of TNF/IL-17 DVD-Ig binding proteins.

| Protein Protein region | Sequence Identifier | Sequence |
|---|---|---|
| E7 VL | SEQ ID NO.: 653 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 654 | GGSGGGGSGGGGS |
| G9-2VL | SEQ ID NO.: 655 | QSVLTQPPSASGTPGQTVSI SCSGSNSNIGRHPVDWYQQV PGAAPKLLIYYDDQRPSGVP DRFSGSQSGTSASLAISGLQ SEDEADYYCATWDDSLGGYV FGSGTKVTVLG |
| CL | SEQ ID NO.: 656 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-SL-G9-2 DVD | SEQ ID NO.: 657 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SASTKGPEVQLLESGGGVVQ PGRSLRLSCAASGFIFRNYG MHWVRQAPGKGLEWVAVISY DGSNKYYADSVKGRFTISRD NSKNTLYLEMNSLRPEDTAV YYCAKVGASGDYYYSYGLDV WGQGTTVTVSS |
| D2 VH | SEQ ID NO.: 658 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO. 659 | ASTKGP |
| G9-2 VH | SEQ ID NO.: 660 | EVQLLESGGGVVQPGRSLRL SCAASGFIFRNYGMHWVRQA PGKGLEWVAVISYDGSNKYY ADSVKGRFTISRDNSKNTLY LEMNSLRPEDTAVYYCAKVG ASGDYYYSYGLDVWGQGTTV TVSS |
| CH | SEQ ID NO.: 661 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK STYRVVSVLTVLHQDWLNGK EYKCKVSNKALPAPIEKTIS |

TABLE 34-continued

Sequences of variable and constant regions of TNF/IL-17 DVD-Ig binding proteins.

| Protein<br>Protein region | Sequence Identifier | Sequence |
|---|---|---|
| | | KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT<br>VARIABLE<br>E7-SL-G9-2 DVD | SEQ ID NO.: 662 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR<u>TVAAP</u>QSVLTQP<br>PSASGTPGQTVSISCSGSNS<br>NIGRHPVDWYQQVPGAAPKL<br>LIYYDDQRPSGVPDRFSGSQ<br>SGTSASLAISGLQSEDEADY<br>YCATWDDSLGGYVFGSGTKV<br>TVLG |
| E7 VL | SEQ ID NO.: 663 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 664 | TVAAP |
| G9-2 VL | SEQ ID NO.: 665 | QSVLTQPPSASGTPGQTVSI<br>SCSGSNSNIGRHPVDWYQQV<br>PGAAPKLLIYYDDQRPSGVP<br>DRFSGSQSGTSASLAISGLQ<br>SEDEADYYCATWDDSLGGYV<br>FGSGTKVTVLG |
| CL | SEQ ID NO.: 666 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>D2-GS10-B6-17 DVD | SEQ ID NO.: 667 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGGGGSEVQLVQSGA<br>EVKKPGSSVKVSCKASGGSF<br>GGYGIGWVRQAPGQGLEWMG<br>GITPFFGFADYAQKFQGRVT<br>ITADESTTTAYMELSGLTSD<br>DTAVYYCARDPNEFWNGYYS<br>THDFDSWGQGTTVTVSS |
| D2 VH | SEQ ID NO.: 668 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 669 | GGGGSGGGGS |
| B6-17 VH | SEQ ID NO.: 670 | EVQLVQSGAEVKKPGSSVKV<br>SCKASGGSFGGYGIGWVRQA<br>PGQGLEWMGGITPFFGFADY<br>AQKFQGRVTITADESTTTAY<br>MELSGLTSDDTAVYYCARDP<br>NEFWNGYYSTHDFDSWGQGT<br>TVTVSS |

TABLE 34-continued

Sequences of variable and constant regions of TNF/IL-17 DVD-Ig binding proteins.

| Protein Protein region | Sequence Identifier | Sequence |
|---|---|---|
| CH | SEQ ID NO.: 671 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-GS10-B6-17 DVD | SEQ ID NO.: 672 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| E7 VL | SEQ ID NO.: 673 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR |
| LINKER | SEQ ID NO.: 674 | GGSGGGGSGS |
| B6-17 VL | SEQ ID NO.: 675 | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| CL | SEQ ID NO.: 676 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-GS6-B6-17 DVD | SEQ ID NO.: 677 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| D2 VH | SEQ ID NO.: 678 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVS |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| | | YLSTASSLDYWGQGTLVTVSS |
| LINKER | SEQ ID NO.: 679 | GGGGSG |
| B6-17 VH | SEQ ID NO.: 680 | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| CH | SEQ ID NO.: 681 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-GS6-B6-17 DVD | SEQ ID NO.: 682 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| E7 VL | SEQ ID NO.: 683 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR |
| LINKER | SEQ ID NO.: 684 | GGSGG |
| B6-17 VL | SEQ ID NO.: 685 | EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| CL | SEQ ID NO.: 686 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-GS14-B6-17 DVD | SEQ ID NO.: 687 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGEVQLV |

TABLE 34-continued

Sequences of variable and constant regions of TNF/IL-17 DVD-Ig binding proteins.

| Protein Protein region | Sequence Identifier | Sequence |
|---|---|---|
| | | QSGAEVKKPGSSVKVSCKAS GGSFGGYGIGWVRQAPGQGL EWMGGITPFFGFADYAQKFQ GRVTITADESTTTAYMELSG LTSDDTAVYYCARDPNEFWN GYYSTHDFDSWGQGTTVTVS S |
| D2 VH | SEQ ID NO.: 688 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 689 | GGGGSGGGGSGGGG |
| B6-17 VH | SEQ ID NO.: 690 | EVQLVQSGAEVKKPGSSVKV SCKASGGSFGGYGIGWVRQA PGQGLEWMGGITPFFGFADY AQKFQGRVTITADESTTTAY MELSGLTSDDTAVYYCARDP NEFWNGYYSTHDFDSWGQGT TVTVSS |
| CH | SEQ ID NO.: 691 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS14-B6-17 DVD | SEQ ID NO.: 692 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGGSGGGGSGGGG SEIVLTQSPDFQSVTPKEKV TITCRASQDIGSELHWYQQK PDQPPKLLIKYASHSTSGVP SRFSGSGSGTDFTLTINGLE AEDAGTYYCHQTDSLPYTFG PGTKVDIKR |
| E7 VL | SEQ ID NO.: 693 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 694 | GGSGGGGSGGGGS |
| B6-17 VL | SEQ ID NO.: 695 | EIVLTQSPDFQSVTPKEKVT ITCRASQDIGSELHWYQQKP DQPPKLLIKYASHSTSGVPS RFSGSGSGTDFTLTINGLEA EDAGTYYCHQTDSLPYTFGP GTKVDIKR |

TABLE 34-continued

Sequences of variable and constant regions of TNF/IL-17 DVD-Ig binding proteins.

| Protein Protein region | Sequence Identifier | Sequence |
|---|---|---|
| CL | SEQ ID NO.: 696 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-SL-B6-17 DVD | SEQ ID NO.: 697 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| D2 VH | SEQ ID NO.: 698 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| LINKER | SEQ ID NO.: 699 | ASTKGP |
| B6-17 VH | SEQ ID NO.: 700 | EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS |
| CH | SEQ ID NO.: 701 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-SL-B6-17 DVD | SEQ ID NO.: 702 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR |
| E7 VL | SEQ ID NO.: 703 | DIQMTQSPSSLSASVGDRVTITCRASQGIRNYLAWYQQKPGKAPKLLIYAASTLQSGVPSRFSGSGSGTDFTLTISSLQP |

TABLE 34-continued

Sequences of variable and constant regions of TNF/IL-17 DVD-Ig binding proteins.

| Protein Protein region | Sequence Identifier | Sequence |
|---|---|---|
| | | EDVATYYCQRYNRAPYTFGQ GTKVEIKR |
| LINKER | SEQ ID NO.: 704 | TVAAP |
| B6-17 VL | SEQ ID NO.: 705 | EIVLTQSPDFQSVTPKEKVT ITCRASQDIGSELHWYQQKP DQPPKLLIKYASHSTSGVPS RFSGSGSGTDFTLTINGLEA EDAGTYYCHQTDSLPYTFGP GTKVDIKR |
| CL | SEQ ID NO.: 706 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-LL-B6-17 DVD | SEQ ID NO.: 707 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SASTKGPSVFPLAPEVQLVQ SGAEVKKPGSSVKVSCKASG GSFGGYGIGWVRQAPGQGLE WMGGITPFFGFADYAQKFQG RVTITADESTTTAYMELSGL TSDDTAVYYCARDPNEFWNG YYSTHDFDSWGQGTTVTVSS |
| D2 VH | SEQ ID NO.: 708 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 709 | ASTKGPSVFPLAP |
| B6-17 VH | SEQ ID NO.: 710 | EVQLVQSGAEVKKPGSSVKV SCKASGGSFGGYGIGWVRQA PGQGLEWMGGITPFFGFADY AQKFQGRVTITADESTTTAY MELSGLTSDDTAVYYCARDP NEFWNGYYSTHDFDSWGQGT TVTVSS |
| CH | SEQ ID NO.: 711 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-LL-B6-17 DVD | SEQ ID NO.: 712 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| | | GTKVEIKRTVAAPSVFIFPP EIVLTQSPDFQSVTPKEKVT ITCRASQDIGSELHWYQQKP DQPPKLLIKYASHSTSGVPS RFSGSGSGTDFTLTINGLEA EDAGTYYCHQTDSLPYTFGP GTKVDIKR |
| E7 VL | SEQ ID NO.: 713 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 714 | TVAAPSVFIFPP |
| B6-17 VL | SEQ ID NO.: 715 | EIVLTQSPDFQSVTPKEKVT ITCRASQDIGSELHWYQQKP DQPPKLLIKYASHSTSGVPS RFSGSGSGTDFTLTINGLEA EDAGTYYCHQTDSLPYTFGP GTKVDIKR |
| CL | SEQ ID NO.: 716 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS10-B6-5 DVD | SEQ ID NO.: 717 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGGGGSEVQLVQSGA EVKKPGESVKISCKASGGSF RSYGISWVRQAPGQGLEWMG GITHFFGITDYAQKFQGRVT ITADESTTTAYMELSGLTSD DTAVYYCAREPNDFWNGYYD THDFDSWGQGTTVTVSS |
| D2 VH | SEQ ID NO.: 718 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 719 | GGGGSGGGGS |
| B6-5 VH | SEQ ID NO.: 720 | EVQLVQSGAEVKKPGESVKI SCKASGGSFRSYGISWVRQA PGQGLEWMGGITHFFGITDY AQKFQGRVTITADESTTTAY MELSGLTSDDTAVYYCAREP NDFWNGYYDTHDFDSWGQGT TVTVSS |
| CH | SEQ ID NO.: 721 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS |

TABLE 34-continued

Sequences of variable and constant regions of TNF/IL-17 DVD-Ig binding proteins.

| Protein Protein region | Sequence Identifier | Sequence |
|---|---|---|
| | | KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS10-B6-5 DVD | SEQ ID NO.: 722 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGGSGGGGSGSEI VLTQSPDFQSVTPKEKVTIT CRASQNIGSELHWYQQKPDQ SPKLLIKYASHSISGVPSRF SGSGSGTDFTLTINGLEAED AATYYCHQSDTLPHTFGQGT KVDIKR |
| E7 VL | SEQ ID NO.: 723 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 724 | GGSGGGGSGS |
| B6-5 VL | SEQ ID NO.: 725 | EIVLTQSPDFQSVTPKEKVT ITCRASQNIGSELHWYQQKP DQSPKLLIKYASHSISGVPS RFSGSGSGTDFTLTINGLEA EDAATYYCHQSDTLPHTFGQ GTKVDIKR |
| CL | SEQ ID NO.: 726 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS6-B6-5 DVD | SEQ ID NO.: 727 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGEVQLVQSGAEVKK PGESVKISCKASGGSFRSYG ISWVRQAPGQGLEWMGGITH FFGITDYAQKFQGRVTITAD ESTTTAYMELSGLTSDDTAV YYCAREPNDFWNGYYDTHDF DSWGQGTTVTVSS |
| D2 VH | SEQ ID NO.: 728 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 729 | GGGGSG |
| B6-5 VH | SEQ ID NO.: 730 | EVQLVQSGAEVKKPGESVKI SCKASGGSFRSYGISWVRQA PGQGLEWMGGITHFFGITDY AQKFQGRVTITADESTTTAY MELSGLTSDDTAVYYCAREP NDFWNGYYDTHDFDSWGQGT TVTVSS |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| CH | SEQ ID NO.: 731 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-B6-5 DVD | SEQ ID NO.: 732 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR<u>TVAAP</u>EIVLTQS PDFQSVTPKEKVTITCRASQ NIGSELHWYQQKPDQSPKLL IKYASHSISGVPSRFSGSGS GTDFTLTINGLEAEDAATYY CHQSDTLPHTFGQGTKVDIK R |
| E7 VL | SEQ ID NO.: 733 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 734 | <u>TVAAP</u> |
| B6-5 VL | SEQ ID NO.: 735 | EIVLTQSPDFQSVTPKEKVT ITCRASQNIGSELHWYQQKP DQSPKLLIKYASHSISGVPS RFSGSGSGTDFTLTINGLEA EDAATYYCHQSDTLPHTFGQ GTKVDIKR |
| CL | SEQ ID NO.: 736 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-SL-B6-15 DVD | SEQ ID NO.: 737 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SA<u>STKGP</u>EVQLVQSGAEVKK PGESLKISCKASGGSFSGYG TSWVRQAPGQGLEWMGGITH FFPGAVDYAQKFQGRVTITAD ESTTTAYMELSGLTSDDTAV YYCARDPNEFWNGYYATHDF DYWGQGTTVTVSS |
| D2 VH | SEQ ID NO.: 738 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS |

TABLE 34-continued

Sequences of variable and constant regions of TNF/IL-17 DVD-Ig binding proteins.

| Protein Protein region | Sequence Identifier | Sequence |
|---|---|---|
| | | YLSTASSLDYWGQGTLVTVSS |
| LINKER | SEQ ID NO.: 739 | ASTKGP |
| B6-15 VH | SEQ ID NO.: 740 | EVQLVQSGAEVKKPGESLKISCKASGGSFSGYGTSWVRQAPGQGLEWMGGITHFFGAVDYAQKFQGRVTITADESTTTAYMELSGLTSDDTAVYYCARDPNEFWNGYYATHDFDYWGQGTTVTVSS |
| CH | SEQ ID NO.: 741 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-GS6-B6-15DVD | SEQ ID NO.: 742 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIKR |
| E7 VL | SEQ ID NO.: 743 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR |
| LINKER | SEQ ID NO.: 744 | GGSGG |
| B6-15 VL | SEQ ID NO.: 745 | EIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIKR |
| CL | SEQ ID NO.: 746 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-GS10-h5C5Vh1 DVD | SEQ ID NO.: 747 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGA |

TABLE 34-continued

Sequences of variable and constant regions of TNF/IL-17 DVD-Ig binding proteins.

| Protein Protein region | Sequence Identifier | Sequence |
|---|---|---|
| | | EVKKPGASVKVSCKASGYTF TDYEFHWVRQAPGQGLEWMG VIHPGNGGTAYNQNFRDRVT ITADKSTSTAYMELSSLRSE DTAVYYCARFLTYEGYFDYW GQGTLVTVSS |
| D2 VH | SEQ ID NO.: 748 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 749 | GGGGSGGGGS |
| H5C5 Vh1VH | SEQ ID NO.: 750 | EVQLVQSGAEVKKPGASVKV SCKASGYTFTDYEFHWVRQA PGQGLEWMGVIHPGNGGTAY NQNFRDRVTITADKSTSTAY MELSSLRSEDTAVYYCARFL TYEGYFDYWGQGTLVTVSS |
| CH | SEQ ID NO.: 751 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS10-h5C5Vk3a DVD | SEQ ID NO.: 752 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGGSGGGGSGSEI VMTQSPATLSVSPGERATLS CKASQSVSIDVGWFQQKPGQ SPRLLIYHASNRYTGVPARF SGSGSGTDFTLTISSLQPED FAVYFCQQDYSSPYTFGQGT KLEIKR |
| E7 VL | SEQ ID NO.: 753 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 754 | GGSGGGGSGS |
| H5C5 Vk3a VL | SEQ ID NO.: 755 | EIVMTQSPATLSVSPGERAT LSCKASQSVSIDVGWFQQKP GQSPRLLIYHASNRYTGVPA RFSGSGSGTDFTLTISSLQP EDFAVYFCQQDYSSPYTFGQ GTKLEIKR |
| CL | SEQ ID NO.: 756 | TVAAPSVFIFPPSDEQLKSG TASVVCLLNNFYPREAKVQW KVDNALQSGNSQESVTEQDS |

TABLE 34-continued

Sequences of variable and constant regions of TNF/IL-17 DVD-Ig binding proteins.

| Protein Protein region | Sequence Identifier | Sequence |
|---|---|---|
| | | KDSTYSLSSTLTLSKADYEK HKVYACEVTHQGLSSPVTKS FNRGEC |
| DVD HEAVY VARIABLE D2-GS10-6C6 DVD | SEQ ID NO.: 757 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGGGGSQVQLQQSGA ELVRPGASVKLSCKASGYTF SDYEIHWVKQTPVHGLAWIG VIHPGNGGTAYNQKFKDKAT LTADKSSSTAYMELSSLTSE DSAVYYCERFLTYEGYFDYW GQGTTLTVSS |
| D2 VH | SEQ ID NO.: 758 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 759 | GGGGSGGGGS |
| 6C6VH | SEQ ID NO.: 760 | QVQLQQSGAELVRPGASVKL SCKASGYTFSDYEIHWVKQT PVHGLAWIGVIHPGNGGTAY NQKFKDKATLTADKSSSTAY MELSSLTSEDSAVYYCERFL TYEGYFDYWGQGTTLTVSS |
| CH | SEQ ID NO.: 761 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD HEAVY VARIABLE D2-GS10-h10F7Vh1a DVD | SEQ ID NO.: 762 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGGGGSEVQLVQSGA EVKKPGSSVKVSCKASGYTF TDYEIHWVRQAPGQGLEWMG VNDPESGGTFYNQKFDGRVT ITADKSTSTAYMELSSLRSE DTAVYYCARYYRYESFYGMD YWGQGTTVTVSS |
| D2 VH | SEQ ID NO.: 763 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |

TABLE 34-continued

Sequences of variable and constant regions of TNF/IL-17 DVD-Ig binding proteins.

| Protein Protein region | Sequence Identifier | Sequence |
|---|---|---|
| LINKER | SEQ ID NO.: 764 | GGGGSGGGGS |
| H10F7Vh1aVH | SEQ ID NO.: 765 | EVQLVQSGAEVKKPGSSVKVSCKASGYTFTDYEIHWVRQAPGQGLEWMGVNDPESGGTFYNQKFDGRVTITADKSTSTAYMELSSLRSEDTAVYYCARYYRYESFYGMDYWGQGTTVTVSS |
| CH | SEQ ID NO.: 766 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-GS10-h10F7Vk1a DVD | SEQ ID NO.: 767 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR<u>GGSGGGGSGS</u>DIQLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR |
| E7 VL | SEQ ID NO.: 768 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR |
| LINKER | SEQ ID NO.: 769 | GGSGGGGSGS |
| H10F7 Vk1a VL | SEQ ID NO.: 770 | DIQLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR |
| CL | SEQ ID NO.: 771 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |
| DVD HEAVY VARIABLE D2-GS6-h5C5Vh1 DVD | SEQ ID NO.: 772 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS<u>GGGGS</u>EVQLVQSGAEVKKPGASVKVSCKASGYTFTDYEFHWVRQAPGQGLEWMGVIHP |

TABLE 34-continued

Sequences of variable and constant regions of TNF/IL-17 DVD-Ig binding proteins.

| Protein Protein region | Sequence Identifier | Sequence |
|---|---|---|
| | | GNGGTAYNQNFRDRVTITAD KSTSTAYMELSSLRSEDTAV YYCARFLTYEGYFDYWGQGT LVTVSS |
| D2 VH | SEQ ID NO.: 773 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 774 | GGGGSG |
| H5C5 Vh1VH | SEQ ID NO.: 775 | EVQLVQSGAEVKKPGASVKV SCKASGYTFTDYEFHWVRQA PGQGLEWMGVIHPGNGGTAY NQNFRDRVTITADKSTSTAY MELSSLRSEDTAVYYCARFL TYEGYFDYWGQGTLVTVSS |
| CH | SEQ ID NO.: 776 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-h5C5Vk1a DVD | SEQ ID NO.: 777 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR<u>TVAAP</u>DIQMTQS PSSLSASVGDRVTITCKASQ SVSIDVGWFQQKPGKSPKLL IYHASNRYTGVPSRFSGSGS GTDFTFTISSLQPEDFATYF CQQDYSSPYTFGQGTKLEIK R |
| E7 VL | SEQ ID NO.: 778 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 779 | TVAAP |
| H5C5 Vk1a VL | SEQ ID NO.: 780 | DIQMTQSPSSLSASVGDRVT ITCKASQSVSIDVGWFQQKP GKSPKLLIYHASNRYTGVPS RFSGSGSGTDFTFTISSLQP EDFATYFCQQDYSSPYTFGQ GTKLEIKR |
| CL | SEQ ID NO.: 781 | TVAAPSVFIFPPSDEQLKSG TASVVCLLNNFYPREAKVQW KVDNALQSGNSQESVTEQDS |

TABLE 34-continued

Sequences of variable and constant regions of TNF/IL-17 DVD-Ig binding proteins.

| Protein Protein region | Sequence Identifier | Sequence |
|---|---|---|
| | | KDSTYSLSSTLTLSKADYEK HKVYACEVTHQGLSSPVTKS FNRGEC |
| DVD HEAVY VARIABLE D2-GS6-h5C5Vh1b DVD | SEQ ID NO.: 782 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGEVQLVQSGAEVKK PGASVKVSCKASGYTFTDYE FHWVRQAPGQGLEWIGVIHP GNGGTAYNQNFRDRATLTAD KSTSTAYMELSSLRSEDTAV YYCTRFLTYEGYFDYWGQGT LVTVSS |
| D2 VH | SEQ ID NO.: 783 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 784 | GGGGSG |
| H5C5 Vh1bVH | SEQ ID NO.: 785 | EVQLVQSGAEVKKPGASVKV SCKASGYTFTDYEFHWVRQA PGQGLEWIGVIHPGNGGTAY NQNFRDRATLTADKSTSTAY MELSSLRSEDTAVYYCTRFL TYEGYFDYWGQGTLVTVSS |
| CH | SEQ ID NO.: 786 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-h5C5Vk3a DVD | SEQ ID NO.: 787 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRTVAAPEIVMTQS PATLSVSPGERATLSCKASQ SVSIDVGWFQQKPGQSPRLL IYHASNRYTGVPARFSGSGS GTDFTLTISSLQPEDFAVYF CQQDYSSPYTFGQGTKLEIK R |
| E7 VL | SEQ ID NO.: 788 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| LINKER | SEQ ID NO.: 789 | TVAAP |
| H5C5 Vk3a VL | SEQ ID NO.: 790 | EIVMTQSPATLSVSPGERAT<br>LSCKASQSVSIDVGWFQQKP<br>GQSPRLLIYHASNRYTGVPA<br>RFSGSGSGTDFTLTISSLQP<br>EDFAVYFCQQDYSSPYTFGQ<br>GTKLEIKR |
| CL | SEQ ID NO.: 791 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>D2-GS6-10F7 DVD | SEQ ID NO.: 792 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGQVQLQQSGAELVR<br>PGTSVTLSCKASGYIFTDYE<br>IHWVKQTPVHGLEWIGVNDP<br>ESGGTFYNQKFDGKAELTAD<br>KSSSTAYMELRSLTSEDSGV<br>YYCTRYYRYESFYGMDYWGQ<br>GTSITVSS |
| D2 VH | SEQ ID NO.: 793 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 794 | GGGGSG |
| F7VH | SEQ ID NO.: 795 | QVQLQQSGAELVRPGTSVTL<br>SCKASGYIFTDYEIHWVKQT<br>PVHGLEWIGVNDPESGGTFY<br>NQKFDGKAELTADKSSSTAY<br>MELRSLTSEDSGVYYCTRYY<br>RYESFYGMDYWGQGTSITVS<br>S |
| CH | SEQ ID NO.: 796 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT<br>VARIABLE<br>E7-SL-10F7 DVD | SEQ ID NO.: 797 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKRTVAAPQIVLTQS<br>PAIMSASPGEKVTMTCSASS |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| | | SISYIYWFQQKPGTSPKRWI YATFELASGVPARFSGSGSG TSYSLTISSMEAEDAATYYC HQRSSYPWTFGGGSKLEIKR |
| E7 VL | SEQ ID NO.: 798 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 799 | TVAAP |
| 10F7 VL | SEQ ID NO.: 800 | QIVLTQSPAIMSASPGEKVT MTCSASSSISYIYWFQQKPG TSPKRWIYATFELASGVPAR FSGSGSGTSYSLTISSMEAE DAATYYCHQRSSYPWTFGGG SKLEIKR |
| CL | SEQ ID NO.: 801 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS6-5C5 DVD | SEQ ID NO.: 802 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGQVQLQQSGAELVR PGASVKLSCKALGYTFTDYE FHWVKQTPVHGLEWIGVIHP GNGGTAYNQNFRDKATLTAD KSSSTAYMELSSLTSEDSGV YYCTRFLTYEGYFDYWGQGT ALTVSS |
| D2 VH | SEQ ID NO.: 803 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 804 | GGGGSG |
| 5C5 VH | SEQ ID NO.: 805 | QVQLQQSGAELVRPGASVKL SCKALGYTFTDYEFHWVKQT PVHGLEWIGVIHPGNGGTAY NQNFRDKATLTADKSSSTAY MELSSLTSEDSGVYYCTRFL TYEGYFDYWGQGTALTVSS |
| CH | SEQ ID NO.: 806 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| | | QQGNVFSCSVMHEALHNHYT<br>QKSLSLSPGK |
| DVD LIGHT<br>VARIABLE<br>E7-SL-5C5 DVD | SEQ ID NO.: 807 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR<u>TVAAP</u>NIVMTQT<br>PKFLLVSPGDRVTITCKASQ<br>SVSIDVGWFQQKPGQSPKLL<br>IYHASNRYTGVPDRFTGSGY<br>GTDFTFTVNTVQAEDLAVYF<br>CQQDYSSPYTFGGGTKLELK<br>R |
| E7 VL | SEQ ID NO.: 808 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 809 | TVAAP |
| 5C5 VL | SEQ ID NO.: 810 | NIVMTQTPKFLLVSPGDRVT<br>ITCKASQSVSIDVGWFQQKP<br>GQSPKLLIYHASNRYTGVPD<br>RFTGSGYGTDFTFTVNTVQA<br>EDLAVYFCQQDYSSPYTFGG<br>GTKLELKR |
| CL | SEQ ID NO.: 811 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>D2-GS6-1D8 DVD | SEQ ID NO.: 812 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGQVQLQQSGAELVR<br>PGASVKLSCKASGYTFSDYE<br>MHWVKQTPVHGLEWIGVIHP<br>GNGGTAYNQKFRDKATLTAD<br>KSSTTAYMELSSLTSEDSAV<br>YYCIRFLTYEGYFDYWGQGT<br>TLTVSS |
| D2 VH | SEQ ID NO.: 813 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 814 | GGGGSG |
| 1D8VH | SEQ ID NO.: 815 | QVQLQQSGAELVRPGASVKL<br>SCKASGYTFSDYEMHWVKQT<br>PVHGLEWIGVIHPGNGGTAY<br>NQKFRDKATLTADKSSTTAY<br>MELSSLTSEDSAVYYCIRFL<br>TYEGYFDYWGQGTTLTVSS |
| CH | SEQ ID NO.: 816 | ASTKGPSVFPLAPSSKSTSG<br>GTAALGCLVKDYFPEPVTVS<br>WNSGALTSGVHTFPAVLQSS<br>GLYSLSSVVTVPSSSLGTQT |

TABLE 34-continued

Sequences of variable and constant regions of TNF/IL-17 DVD-Ig binding proteins.

| Protein Protein region | Sequence Identifier | Sequence |
|---|---|---|
| | | YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-1D8 DVD | SEQ ID NO.: 817 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR<u>TVAAP</u>SIVMTQT PKFLLVSAGDRVTITCKASQ SVNNDVAWFQHKPGQSPKLL INYASNRYTGVPDRFTGSGY GTDFTFTISTVQSEDLAIYF CQQDYGSPYTFGGGTTLEIK R |
| E7 VL | SEQ ID NO.: 818 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 819 | TVAAP |
| 1D8 VL | SEQ ID NO.: 820 | SIVMTQTPKFLLVSAGDRVT ITCKASQSVNNDVAWFQHKP GQSPKLLINYASNRYTGVPD RFTGSGYGTDFTFTISTVQS EDLAIYFCQQDYGSPYTFGG GTTLEIKR |
| CL | SEQ ID NO.: 821 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS6-6C6 DVD | SEQ ID NO.: 822 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S<u>GGGGSG</u>QVQLQQSGAELVR PGASVKLSCKASGYTFSDYE IHWVKQTPVHGLAWIGVIHP GNGGTAYNQKFKDKATLTAD KSSSTAYMELSSLTSEDSAV YYCERFLTYEGYFDYWGQGT TLTVSS |
| D2 VH | SEQ ID NO.: 823 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |

TABLE 34-continued

Sequences of variable and constant regions of TNF/IL-17 DVD-Ig binding proteins.

| Protein Protein region | Sequence Identifier | Sequence |
|---|---|---|
| LINKER | SEQ ID NO.: 824 | GGGGSG |
| 6C6VH | SEQ ID NO.: 825 | QVQLQQSGAELVRPGASVKL SCKASGYTFSDYEIHWVKQT PVHGLAWIGVIHPGNGGTAY NQKFKDKATLTADKSSSTAY MELSSLTSEDSAVYYCERFL TYEGYFDYWGQGTTLTVSS |
| CH | SEQ ID NO.: 826 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-SL-6C6 DVD | SEQ ID NO.: 827 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRTVAAPSIVMTQT PKFLLVSAGDRVTITCKASQ SVNNDVAWYQHKPGQSPKLL INYASNRYTGVPDRFTGSGY GTDFTFTISTVQAEDLAIYF CQQDYGSPYTFGGGTKLEIK R |
| E7 VL | SEQ ID NO.: 828 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 829 | TVAAP |
| 6C6VL | SEQ ID NO.: 830 | SIVMTQTPKFLLVSAGDRVT ITCKASQSVNNDVAWYQHKP GQSPKLLINYASNRYTGVPD RFTGSGYGTDFTFTISTVQA EDLAIYFCQQDYGSPYTFGG GTKLEIKR |
| CL | SEQ ID NO.: 831 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS6-8B12 DVD | SEQ ID NO.: 832 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGQVQLKESGPGLVA PSQSLSITCTISGFSLTSYG VHWVRQPPGKGLEWLVVIWS DGTTTYNSALKSRLSITRDN SKSQVFLKMNSLQTDDTAIY |

TABLE 34-continued

Sequences of variable and constant regions of TNF/IL-17 DVD-Ig binding proteins.

| Protein Protein region | Sequence Identifier | Sequence |
|---|---|---|
| | | YCARDSTWDYYYTMDYWGQGTPVTVSS |
| D2 VH | SEQ ID NO.: 833 | EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSS |
| LINKER | SEQ ID NO.: 834 | GGGGSG |
| 8B12VH | SEQ ID NO.: 835 | QVQLKESGPGLVAPSQSLSITCTISGFSLTSYGVHWVRQPPGKGLEWLVVIWSDGTTTYNSALKSRLSITRDNSKSQVFLKMNSLQTDDTAIYYCARDSTWDYYYTMDYWGQGTPVTVSS |
| CH | SEQ ID NO.: 836 | ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK |
| DVD LIGHT VARIABLE E7-SL-8B12 DVD | SEQ ID NO.: 837 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVYTFGGGTKLEIKR |
| E7 VL | SEQ ID NO.: 838 | DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR |
| LINKER | SEQ ID NO.: 839 | TVAAP |
| 8B12 VL | SEQ ID NO.: 840 | DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVYTFGGGTKLEIKR |
| CL | SEQ ID NO.: 841 | TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| DVD HEAVY VARIABLE<br>D2-GS10-B6-11 DVD | SEQ ID NO.: 842 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>SGGGGSGGGGSEVQLVQSGA<br>EVKKPGSSVKVSCKASGGSF<br>LSYGFSWVRQAPGQGLEWMG<br>GITPFFGFADYAQKFQGRVT<br>ITADESTTTAYMELSGLTSD<br>DTAVYYCAREPNDFWNGYYT<br>THHFDYWGQGTTVTVSS |
| D2 VH | SEQ ID NO.: 843 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 844 | GGGGSGGGGS |
| B6-11VH | SEQ ID NO.: 845 | EVQLVQSGAEVKKPGSSVKV<br>SCKASGGSFLSYGFSWVRQA<br>PGQGLEWMGGITPFFGFADY<br>AQKFQGRVTITADESTTTAY<br>MELSGLTSDDTAVYYCAREP<br>NDFWNGYYTTHHFDYWGQGT<br>TVTVSS |
| CH | SEQ ID NO.: 846 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |
| DVD LIGHT VARIABLE<br>E7-GS10-B6.1 DVD | SEQ ID NO.: 847 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKRGGSGGGGSGSEI<br>VLTQSPDFQSVTPKEKVTIT<br>CRASQNIGSALHWYQQKPDQ<br>SPKLLIKYASQSISGVPSRF<br>SGSGSGTDFTLTINGLEAED<br>AGTYYCHQSTSLPHTFGQGT<br>KVDIKR |
| E7 VL | SEQ ID NO.: 848 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 849 | GGSGGGGSGS |
| B6.1 VL | SEQ ID NO.: 850 | EIVLTQSPDFQSVTPKEKVT<br>ITCRASQNIGSALHWYQQKP |

TABLE 34-continued

Sequences of variable and constant regions of TNF/IL-17 DVD-Ig binding proteins.

| Protein Protein region | Sequence Identifier | Sequence |
|---|---|---|
| | | DQSPKLLIKYASQSISGVPS RFSGSGSGTDFTLTINGLEA EDAGTYYCHQSTSLPHTFGQ GTKVDIKR |
| CL | SEQ ID NO.: 851 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-LL-B6-11 DVD | SEQ ID NO.: 852 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SASTKGPSVFPLAPEVQLVQ SGAEVKKPGSSVKVSCKASG GSFLSYGFSWVRQAPGQGLE WMGGITPFFGFADYAQKFQG RVTITADESTTTAYMELSGL TSDDTAVYYCAREPNDFWNG YYTTHHFDYWGQGTTVTVSS |
| D2 VH | SEQ ID NO.: 853 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 854 | ASTKGPSVFPLAP |
| B6-11VH | SEQ ID NO.: 855 | EVQLVQSGAEVKKPGSSVKV SCKASGGSFLSYGFSWVRQA PGQGLEWMGGITPFFGFADY AQKFQGRVTITADESTTTAY MELSGLTSDDTAVYYCAREP NDFWNGYYTTHHFDYWGQGT TVTVSS |
| CH | SEQ ID NO.: 856 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-LL-B6.1 DVD | SEQ ID NO.: 857 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRTVAAPSVFIFPP EIVLTQSPDFQSVTPKEKVT ITCRASQNIGSALHWYQQKP DQSPKLLIKYASQSISGVPS RFSGSGSGTDFTLTINGLEA EDAGTYYCHQSTSLPHTFGQ GTKVDIKR |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| E7 VL | SEQ ID NO.: 858 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 859 | TVAAPSVFIFPP |
| B6.1 VL | SEQ ID NO.: 860 | EIVLTQSPDFQSVTPKEKVT<br>ITCRASQNIGSALHWYQQKP<br>DQSPKLLIKYASQSISGVPS<br>RFSGSGSGTDFTLTINGLEA<br>EDAGTYYCHQSTSLPHTFGQ<br>GTKVDIKR |
| CL | SEQ ID NO.: 861 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY<br>VARIABLE<br>D2-SL-B6-11 DVD | SEQ ID NO.: 862 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>STVAAPEVQLVQSGAEVKKP<br>GSSVKVSCKASGGSFLSYGF<br>SWVRQAPGQGLEWMGGITPF<br>FGFADYAQKFQGRVTITADE<br>STTTAYMELSGLTSDDTAVY<br>YCAREPNDFWNGYYTTHHFD<br>YWGQGTTVTVSS |
| D2 VH | SEQ ID NO.: 863 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 864 | TVAAP |
| B6-11VH | SEQ ID NO.: 865 | EVQLVQSGAEVKKPGSSVKV<br>SCKASGGSFLSYGFSWVRQA<br>PGQGLEWMGGITPFFGFADY<br>AQKFQGRVTITADESTTTAY<br>MELSGLTSDDTAVYYCAREP<br>NDFWNGYYTTHHFDYWGQGT<br>TVTVSS |
| CH | SEQ ID NO.: 866 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG<br>PSVFLFPPKPKDTLMISRTP<br>EVTCVVVDVSHEDPEVKFNW<br>YVDGVEVHNAKTKPREEQYN<br>STYRVVSVLTVLHQDWLNGK<br>EYKCKVSNKALPAPIEKTIS<br>KAKGQPREPQVYTLPPSRDE<br>LTKNQVSLTCLVKGFYPSDI<br>AVEWESNGQPENNYKTTPPV<br>LDSDGSFFLYSKLTVDKSRW<br>QQGNVFSCSVMHEALHNHYT<br>QKSLSLSPGK |

TABLE 34-continued

Sequences of variable and constant regions of TNF/IL-17 DVD-Ig binding proteins.

| Protein<br>Protein region | Sequence Identifier | Sequence<br>12345678901234567890 |
|---|---|---|
| DVD LIGHT VARIABLE<br>E7-GS6-B6.1 DVD | SEQ ID NO.: 867 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR<u>GGSGG</u>EIVLTQS<br>PDFQSVTPKEKVTITCRASQ<br>NIGSALHWYQQKPDQSPKLL<br>IKYASQSISGVPSRFSGSGS<br>GTDFTLTINGLEAEDAGTYY<br>CHQSTSLPHTFGQGTKVDIK<br>R |
| E7 VL | SEQ ID NO.: 868 | DIQMTQSPSSLSASVGDRVT<br>ITCRASQGIRNYLAWYQQKP<br>GKAPKLLIYAASTLQSGVPS<br>RFSGSGSGTDFTLTISSLQP<br>EDVATYYCQRYNRAPYTFGQ<br>GTKVEIKR |
| LINKER | SEQ ID NO.: 869 | GGSGG |
| B6.1VL | SEQ ID NO.: 870 | EIVLTQSPDFQSVTPKEKVT<br>ITCRASQNIGSALHWYQQKP<br>DQSPKLLIKYASQSISGVPS<br>RFSGSGSGTDFTLTINGLEA<br>EDAGTYYCHQSTSLPHTFGQ<br>GTKVDIKR |
| CL | SEQ ID NO.: 871 | TVAAPSVFIFPPSDEQLKSG<br>TASVVCLLNNFYPREAKVQW<br>KVDNALQSGNSQESVTEQDS<br>KDSTYSLSSTLTLSKADYEK<br>HKVYACEVTHQGLSSPVTKS<br>FNRGEC |
| DVD HEAVY VARIABLE<br>D2-SL-B6-16DVD | SEQ ID NO.: 872 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S<u>TVAAP</u>EVQLVQSGAEVKMP<br>GSSLKISCKASGGSFRGYGI<br>SWVRQAPGQGLEWMGGITPF<br>FGWADYAQKFQGRVTITADE<br>STTTAYMELSGLTSDDTAVY<br>YCARDPNEFWNGYYDTHHFD<br>YWGQGTTVTVSS |
| D2 VH | SEQ ID NO.: 873 | EVQLVESGGGLVQPGRSLRL<br>SCAASGFTFDDYAMHWVRQA<br>PGKGLEWVSAITWNSGHIDY<br>ADSVEGRFTISRDNAKNSLY<br>LQMNSLRAEDTAVYYCAKVS<br>YLSTASSLDYWGQGTLVTVS<br>S |
| LINKER | SEQ ID NO.: 874 | TVAAP |
| B6-16VH | SEQ ID NO.: 875 | EVQLVQSGAEVKMPGSSLKI<br>SCKASGGSFRGYGISWVRQA<br>PGQGLEWMGGITPFFGWADY<br>AQKFQGRVTITADESTTTAY<br>MELSGLTSDDTAVYYCARDP<br>NEFWNGYYDTHHFDYWGQGT<br>TVTVSS |
| CH | SEQ ID NO.: 876 | ASTKGPSVFPLAPSSKSTSG<br>GTAALGCLVKDYFPEPVTVS<br>WNSGALTSGVHTFPAVLQSS<br>GLYSLSSVVTVPSSSLGTQT<br>YICNVNHKPSNTKVDKKVEP<br>KSCDKTHTCPPCPAPELLGG |

TABLE 34-continued

Sequences of variable and constant regions of TNF/IL-17 DVD-Ig binding proteins.

| Protein Protein region | Sequence Identifier | Sequence 12345678901234567890 |
|---|---|---|
| | | PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |
| DVD LIGHT VARIABLE E7-GS6-B6-16 DVD | SEQ ID NO.: 877 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKRGGSGGEIVLTQS PDFQSVTPKEKVTITCRASQ DIGSALHWYQQKPDQSPKLL IKYASHSVSGVPSRFSGSGS GTDFTLTINGLEAEDAGTYY CHQSDILPHTFGPGTKVDIK R |
| E7 VL | SEQ ID NO.: 878 | DIQMTQSPSSLSASVGDRVT ITCRASQGIRNYLAWYQQKP GKAPKLLIYAASTLQSGVPS RFSGSGSGTDFTLTISSLQP EDVATYYCQRYNRAPYTFGQ GTKVEIKR |
| LINKER | SEQ ID NO.: 879 | GGSGG |
| B6-16VL | SEQ ID NO.: 880 | EIVLTQSPDFQSVTPKEKVT ITCRASQDIGSALHWYQQKP DQSPKLLIKYASHSVSGVPS RFSGSGSGTDFTLTINGLEA EDAGTYYCHQSDILPHTFGP GTKVDIKR |
| CL | SEQ ID NO.: 881 | TVAAPSVFIFPPSDEQLKSG TASVVCLLNNFYPREAKVQW KVDNALQSGNSQESVTEQDS KDSTYSLSSTLTLSKADYEK HKVYACEVTHQGLSSPVTKS FNRGEC |
| DVD HEAVY VARIABLE D2-GS6-B6-16DVD | SEQ ID NO.: 882 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS SGGGGSGEVQLVQSGAEVKM PGSSLKISCKASGGSFRGYG ISWVRQAPGQGLEWMGGITP FFGWADYAQKFQGRVTITAD ESTTTAYMELSGLTSDDTAV YYCARDPNEFWNGYYDTHHF DYWGQGTTVTVSS |
| D2 VH | SEQ ID NO.: 883 | EVQLVESGGGLVQPGRSLRL SCAASGFTFDDYAMHWVRQA PGKGLEWVSAITWNSGHIDY ADSVEGRFTISRDNAKNSLY LQMNSLRAEDTAVYYCAKVS YLSTASSLDYWGQGTLVTVS S |
| LINKER | SEQ ID NO.: 884 | GGGGSG |
| B6-16VH | SEQ ID NO.: 885 | EVQLVQSGAEVKMPGSSLKI SCKASGGSFRGYGISWVRQA |

TABLE 34-continued

Sequences of variable and constant regions of TNF/IL-17 DVD-Ig binding proteins.

| Protein Protein region | Sequence Identifier | Sequence 12345678901234567890 |
|---|---|---|
|  |  | PGQGLEWMGGITPFFGWADY AQKFQGRVTITADESTTTAY MELSGLTSDDTAVYYCARDP NEFWNGYYDTHHFDYWGQGT TVTVSS |
| CH | SEQ ID NO.: 886 | ASTKGPSVFPLAPSSKSTSG GTAALGCLVKDYFPEPVTVS WNSGALTSGVHTFPAVLQSS GLYSLSSVVTVPSSSLGTQT YICNVNHKPSNTKVDKKVEP KSCDKTHTCPPCPAPELLGG PSVFLFPPKPKDTLMISRTP EVTCVVVDVSHEDPEVKFNW YVDGVEVHNAKTKPREEQYN STYRVVSVLTVLHQDWLNGK EYKCKVSNKALPAPIEKTIS KAKGQPREPQVYTLPPSRDE LTKNQVSLTCLVKGFYPSDI AVEWESNGQPENNYKTTPPV LDSDGSFFLYSKLTVDKSRW QQGNVFSCSVMHEALHNHYT QKSLSLSPGK |

3.4: DVD-Ig Heavy and Light Chain Combinations

The following table lists the heavy and light chain sequences used for the expression of different TNF/IL-17 DVD-Ig binding proteins.

TABLE 35

| DVD-Ig Name | Heavy chain construct | Light chain construct |
|---|---|---|
| D2E7-B6.2 DVD-Ig | D2-GS6-B6 DVD HC | E7-SL-B6 DVD LC |
| D2E7-B6.4DVD-Ig | D2-SL-B6 DVD HC | E7-SL-B6 DVD LC |
| D2E7-G9.1 DVD-Ig | D2-GS6-G9 DVD HC | E7-GS6-G9 DVD LC |
| D2E7-G9.2DVD-Ig | D2-GS6-G9 DVD HC | E7-SL-G9 DVD LC |
| D2E7-G9.3DVD-Ig | D2-SL-G9 DVD HC | E7-GS6-G9 DVD LC |
| D2E7-G9.4 DVD-Ig | D2-SL-G9 DVD HC | E7-SL-G9 DVD LC |
| D2E7-B6-5.2 DVD-Ig | D2-GS6-B6-5 DVD HC | E7-SL-B6-5 DVD LC |
| D2E7-B6-5.8 DVD-Ig | D2-GS10-B6-5 DVD HC | E7-GS10-B6-5 DVD LC |
| D2E7-B6-11.3 DVD-Ig | D2-SL-B6-11 DVD HC | E7-GS6-B6.1 DVD LC |
| D2E7-B6-11.5 DVD-Ig | D2-LL-B6-11 DVD HC | E7-LL-B6.1 DVD LC |
| D2E7-B6-11.8 DVD-Ig | D2-GS10-B6-11 DVD HC | E7-GS10-B6.1 DVD LC |
| D2E7-B6-15.3 DVD-Ig | D2-SL-B6-15 DVD HC | E7-GS6-B6-15 DVD LC |
| D2E7-B6-16.1 DVD-Ig | D2-GS6-B6-16 DVD HC | E7-GS6-B6-16 DVD LC |
| D2E7-B6-16.3 DVD-Ig | D2-SL-B6-16 DVD HC | E7-GS6-B6-16 DVD LC |
| D2E7-B6-17.1 DVD-Ig | D2-GS6-B6-17 DVD HC | E7-GS6-B6-17 DVD LC |
| D2E7-B6-17.2 DVD-Ig | D2-GS6-B6-17 DVD HC | E7-SL-B6-17 DVD LC |
| D2E7-B6-17.3 DVD-Ig | D2-SL-B6-17 DVD HC | E7-GS6-B6-17 DVD LC |
| D2E7-B6-17.4 DVD-Ig | D2-SL-B6-17 DVD HC | E7-SL-B6-17 DVD LC |
| D2E7-B6-17.5 DVD-Ig | D2-LL-B6-17 DVD HC | E7-LL-B6-17 DVD LC |
| D2E7-B6-17.6 DVD-Ig | D2-SL-B6-17 DVD HC | E7-LL-B6-17 DVD LC |
| D2E7-B6-17.7 DVD-Ig | D2-LL-B6-17 DVD HC | E7-SL-B6-17 DVD LC |
| D2E7-B6-17.8 DVD-Ig | D2-GS10-B6-17 DVD HC | E7-GS10-B6-17 DVD LC |
| D2E7-B6-17.9 DVD-Ig | D2-GS14-B6-17 DVD HC | E7-GS14-B6-17 DVD LC |
| D2E7-G9-1.1 DVD-Ig | D2-GS6-G9 DVD HC | E7-GS6-G9-1 DVD LC |
| D2E7-G9-1.2 DVD-Ig | D2-GS6-G9 DVD HC | E7-SL-G9-1 DVD LC |
| D2E7-G9-1.3 DVD-Ig | D2-SL-G9 DVD HC | E7-GS6-G9-1 DVD LC |
| D2E7-G9-1.4 DVD-Ig | D2-SL-G9 DVD HC | E7-SL-G9-1 DVD LC |
| D2E7-G9-2.1 DVD-Ig | D2-GS6-G9-2 DVD HC | E7-GS6-G9-2 DVD LC |
| D2E7-G9-2.2 DVD-Ig | D2-GS6-G9-2 DVD HC | E7-SL-G9-2 DVD LC |
| D2E7-G9-2.3 DVD-Ig | D2-SL-G9-2 DVD HC | E7-GS6-G9-2 DVD LC |
| D2E7-G9-2.4 DVD-Ig | D2-SL-G9-2 DVD HC | E7-SL-G9-2 DVD LC |
| D2E7-G9-2.8 DVD-Ig | D2-GS10-G9-2 DVD HC | E7-GS10-G9-2 DVD LC |
| D2E7-G9-2.9 DVD-Ig | D2-GS14-G9-2 DVD HC | E7-GS14-G9-2 DVD LC |
| D2E7-G9-4.1 DVD-Ig | D2-GS6-G9 DVD HC | E7-GS6-G9-4 DVD LC |
| D2E7-G9-4.2 DVD-Ig | D2-GS6-G9 DVD HC | E7-SL-G9-4 DVD LC |
| D2E7-G9-4.3 DVD-Ig | D2-SL-G9 DVD HC | E7-GS6-G9-4 DVD LC |
| D2E7-G9-4.4 DVD-Ig | D2-SL-G9 DVD HC | E7-SL-G9-4 DVD LC |
| D2E7-G9-M2.1 DVD-Ig | D2-GS6-G9 DVD HC | E7-GS6-G9-M2 DVD LC |

TABLE 35-continued

| DVD-Ig Name | Heavy chain construct | Light chain construct |
|---|---|---|
| D2E7-G9-M2.2 DVD-Ig | D2-GS6-G9 DVD HC | E7-SL-G9-M2 DVD LC |
| D2E7-G9-M2.3 DVD-Ig | D2-SL-G9 DVD HC | E7-GS6-G9-M2 DVD LC |
| D2E7-G9-M2.4 DVD-Ig | D2-SL-G9 DVD HC | E7-SL-G9-M2 DVD LC |
| D2E7-h5C5.8 DVD-Ig | D2-GS6-h5C5Vh1 DVD HC | E7-SL-h5C5Vk1a DVD LC |
| D2E7-h5C5.9DVD-Ig | D2-GS6-h5C5Vh1b DVD HC | E7-SL-h5C5Vk1a DVD LC |
| D2E7-h5C5.15 DVD-Ig | D2-GS6-h5C5Vh1b DVD HC | E7-SL-h5C5Vk3a DVD LC |
| D2E7-h5C5DVD.8-Ig | D2-GS10-h5C5.Vh1 DVD HC | E7-GS10-h5C5Vk3a DVD LC |
| D2E7-10F7 DVD-Ig | D2-GS6-10F7 DVD HC | E7-SL-10F7 DVD LC |
| D2E7-h10F7.8 DVD-Ig | D2-GS10-h10F7Vh1a DVD HC | E7-GS10-h10F7Vk1a DVD LC |
| D2E7-1D8DVD-Ig | D2-GS6-1D8 DVD HC | E7-SL-1D8 DVD LC |
| D2E7-5C5 DVD-Ig | D2-GS6-5C5 DVD HC | E7-SL-5C5 DVD LC |
| D2E7-8B12 DVD-Ig | D2-GS6-8B12 DVD HC | E7-SL-8B12 DVD LC |
| D2E7-6C6 DVD-Ig | D2-GS6-6C6 DVD HC | E7-SL-6C6 DVD LC |
| D2E7-6C6.8 DVD-Ig | D2-GS10-6C6 DVD HC | E7-GS10-h5C5Vk3a DVD LC |

3.5: Functional Characterization of TNF/IL-17 DVD-Ig Proteins 3.5.1: IL-17 Enzyme-Linked Immunosorbent Assay Protocol IL-17 binding by TNF/IL-17 DVD-Ig binding proteins was assessed by ELISA (assay described above, Example 1.5.1). Results are shown in the table below.

TABLE 36

Binding of TNF/IL-17 DVD-Ig proteins to human IL-17 by ELISA

| DVD-Ig Name | EC50 in hIL-17 ELISA (pM) |
|---|---|
| D2E7-B6.2 DVD-Ig | 540 |
| D2E7-B6.4DVD-Ig | 20000 |
| D2E7-G9.1 DVD-Ig | 234 |
| D2E7-G9.2DVD-Ig | 201 |
| D2E7-G9.3DVD-Ig | 167 |
| D2E7-G9.4 DVD-Ig | 163 |
| D2E7-B6-5.2 DVD-Ig | 167 |
| D2E7-B6-5.8 DVD-Ig | 150 |
| D2E7-B6-11.3 DVD-Ig | 140 |
| D2E7-B6-11.5 DVD-Ig | 110 |
| D2E7-B6-11.8 DVD-Ig | 130 |
| D2E7-B6-15.3 DVD-Ig | 2000 |
| D2E7-B6-16.1 DVD-Ig | 363 |
| D2E7-B6-16.3 DVD-Ig | 8000 |
| D2E7-B6-17.1 DVD-Ig | 210 |
| D2E7-B6-17.2 DVD-Ig | 180 |
| D2E7-B6-17.3 DVD-Ig | 153 |
| D2E7-B6-17.4 DVD-Ig | 171 |
| D2E7-B6-17.5 DVD-Ig | >500 |
| D2E7-B6-17.6 DVD-Ig | 150 |
| D2E7-B6-17.7 DVD-Ig | 150 |
| D2E7-B6-17.8 DVD-Ig | 70 |
| D2E7-B6-17.9 DVD-Ig | 50 |
| D2E7-G9-1.1 DVD-Ig | 190 |
| D2E7-G9-1.2 DVD-Ig | 170 |
| D2E7-G9-1.3 DVD-Ig | 130 |
| D2E7-G9-1.4 DVD-Ig | 1000 |
| D2E7-G9-2.1 DVD-Ig | 230 |
| D2E7-G9-2.2 DVD-Ig | 200 |
| D2E7-G9-2.3 DVD-Ig | 190 |
| D2E7-G9-2.4 DVD-Ig | 160 |
| D2E7-G9-2.8 DVD-Ig | 153 |
| D2E7-G9-2.9 DVD-Ig | 171 |
| D2E7-G9-4.1 DVD-Ig | 270 |
| D2E7-G9-4.2 DVD-Ig | 200 |
| D2E7-G9-4.3 DVD-Ig | 190 |
| D2E7-G9-4.4 DVD-Ig | 200 |
| D2E7-G9-M2.1 DVD-Ig | 200 |
| D2E7-G9-M2.2 DVD-Ig | 190 |
| D2E7-G9-M2.3 DVD-Ig | 160 |
| D2E7-G9-M2.4 DVD-Ig | 200 |
| D2E7-h5C5.8 DVD-Ig | 180 |
| D2E7-h5C5.9DVD-Ig | 142 |
| D2E7-h5C5.15 DVD-Ig | 211 |
| D2E7-h10F7.8 DVD-Ig | 182 |
| D2E7-h5C5DVD.8-Ig | 1416 |
| D2E7-6C6.8 DVD-Ig | 528 |
| D2E7-10F7 DVD-Ig | 238 |
| D2E7-1D8DVD-Ig | 3300 |
| D2E7-5C5 DVD-Ig | 500 |
| D2E7-8B12 DVD-Ig | 300 |
| D2E7-6C6 DVD-Ig | 1500 |

3.5.2: IL-17 and S1P-Induced IL-6 Secretion from Murine Embryonic Fibroblast Cell Line (NIH3T3)

The murine NIH3T3 cell line (ATCC #CRL-1658) secretes IL-6 in response to murine, rat or rabbit IL-17 and S1P (Cayman Chemical, Cat#62570). The IL-17 induced IL-6 secretion is inhibited by neutralizing anti-IL-17 antibodies.

NIH3T3 cells were maintained in assay medium: DMEM (Invitrogen Cat#11965-092) with 10% fetal bovine serum (Gibco#26140-079), 1% Non Essential Amino Acids, 2 mM L-glutamine, 1 mM sodium pyruvate, penicillin G (100 U/500 ml) and streptomycin (100 µg/500 ml). Cells were grown in T150 flasks until they were about 80-90% confluent the day of the assay.

Murine IL17A HIS (Abbott, A-1229793.0) was diluted to 40 µg/mL in 0.1% BSA/PBS without $Ca^{2+}$ and $Mg^{2+}$, aliquoted, and stored frozen. Rat IL17A (Prospec bio, Cat#CYT-542) was reconstituted in sterile PBS, without $Ca^{2+}$ and $Mg^{2+}$, with 0.1% BSA, aliquoted and stored frozen at 100 µg/mL. Rabbit IL17A (Abbott, A-1239293.0) was aliquoted and stored frozen at 260 µg/mL. S1p was reconstituted in 0.3 M NaOH at 10.54 mM, aliquoted, and stored frozen. Freshly thawed IL-17 antibodies were diluted to 200 µg/ml (4×) in assay medium. Serial dilutions of antibodies were made in a separate plate (4× concentrations), mixed with equal volume of 40 ng/ml (4×) murine or rat IL-17A or 100 ng/mL rabbit IL17A, and incubated at 37° C. for 1 hr.

NIH3T3 cells (typically about 400,000 cells in 50 µl assay medium) were added to each well of a 96-well flat-bottom tissue culture plate (Costar #3599), followed by addition of 50 µl of the pre-incubated antibody plus IL-17 mix. S1P at 100 µM (10×) was added in 11 µl of media to each well. The final concentration of IL-17A was 10 ng/ml for murine and rat and 25 ng/mL for rabbit. The final concentration for S1P was 10 µM. Cells were incubated for about 24 hrs at 37° C. The media supernatants were then collected. The level of IL-17 neutralization was measured by determination of IL-6 amounts in supernatant using a commercial Meso Scale Discovery kit (cat# K112AKA-4) according to manufacturer's instruction. IC50 values were obtained using logarithm of antibody versus IL-6 amount variable slope fit.

3.5.3: IL-17 Neutralization Potency of TNF/IL-17 DVD-Ig Molecules

Multiple DVD-Ig molecules having iterative changes in the linkers (short versus long linker and different sequences) connecting the outer D2E7 variable domains to the inner B6-17 variable domains were generated for functional characterization (B6-5.2, B6-5.8, B6-11.3, B6-11.5, B6-11.8, etc.). Potency of DVD-Ig molecules was assessed using IL-17 or IL-17A/F driven human IL-6 production in HS27 cells for human and cyno antigens (assay described above, Example 1.5.2) or IL-17 plus S1P driven mouse IL-6 production in NIH3T3 cells for rat, mouse, and rabbit antigens (assay described above, Example 3.5.2). The table below summarizes potencies to human IL-17A and A/F and cyno, rat, mouse and rabbit IL-17A.

TABLE 37

| TNF/IL-17 DVD-Ig | Potency (nM) | | | | | |
|---|---|---|---|---|---|---|
| | Hu IL-17A | Hu IL-17A/F | Cyno IL-17A | Rat IL-17A | Mouse IL-17A | Rabbit IL-17A |
| D2E7-B6.2 DVD-Ig | 3.2 | ND | ND | ND | ND | ND |
| D2E7-B6.4DVD-Ig | 85.9 | ND | ND | ND | ND | ND |
| D2E7-G9.1 DVD-Ig | 2.5 | ND | ND | ND | ND | ND |
| D2E7-G9.2DVD-Ig | 5.6 | ND | ND | ND | ND | ND |
| D2E7-G9.3DVD-Ig | 1.6 | ND | ND | ND | ND | ND |
| D2E7-G9.4 DVD-Ig | 1.8 | ND | ND | ND | ND | ND |
| D2E7-B6-5.2 DVD-Ig | 1.42 | ND | ND | ND | ND | 0.32 |
| D2E7-B6-5.8 DVD-Ig | 0.064 | 0.233 | 0.13 | 5.2 | 8 | 11 |
| D2E7-B6-11.3 DVD-Ig | 0.519 | 3.400 | 0.622 | >20 | NI | ND |
| D2E7-B6-11.5 DVD-Ig | 0.349 | 1.760 | 0.535 | >20 | NI | ND |
| D2E7-B6-11.8 DVD-Ig | 0.547 | 1.780 | 1.148 | ND | ND | 0.23 |
| D2E7-B6-16.1 DVD-Ig | 0.758 | ND | 2.711 | ND | NI | ND |
| D2E7-B6-17.1 DVD-Ig | 0.335 | ND | 0.913 | >20 | NI | NI |
| D2E7-B6-17.2 DVD-Ig | 0.282 | ND | 0.509 | ND | NI | ND |
| D2E7-B6-17.3 DVD-Ig | 0.188 | 0.488 | 0.588 | >20 | NI | ND |
| D2E7-B6-17.4 DVD-Ig | 0.453 | 0.545 | 1.465 | >20 | NI | >20 |
| D2E7-B6-17.6 DVD-Ig | >1 | ND | ND | ND | ND | ND |
| D2E7-B6-17.7 DVD-Ig | >1 | ND | ND | ND | ND | ND |
| D2E7-B6-17.8 DVD-Ig | 0.035 | 0.210 | 0.082 | 5.1 | 11 | 6.8 |
| D2E7-B6-17.9 DVD-Ig | 0.027 | 0.167 | 0.060 | ND | >20 | ND |
| D2E7-G9-1.1 DVD-Ig | 0.882 | ND | 2.350 | ND | ND | ND |
| D2E7-G9-1.2 DVD-Ig | 3.004 | ND | 11.070 | ND | ND | ND |
| D2E7-G9-1.3 DVD-Ig | 0.507 | ND | 4.276 | ND | ND | ND |
| D2E7-G9-1.4 DVD-Ig | 0.828 | ND | 4.168 | ND | ND | ND |
| D2E7-G9-2.1 DVD-Ig | 0.407 | ND | 1.710 | ND | ND | ND |
| D2E7-G9-2.2 DVD-Ig | 0.482 | ND | 2.405 | ND | ND | ND |
| D2E7-G9-2.3 DVD-Ig | 0.254 | 0.384 | 1.381 | ND | ND | ND |
| D2E7-G9-2.4 DVD-Ig | 0.227 | 0.696 | 1.476 | ND | ND | ND |
| D2E7-G9-2.8 DVD-Ig | 0.160 | 0.435 | 0.798 | NI | ND | ND |
| D2E7-G9-M2.1 DVD-Ig | 0.660 | ND | 4.530 | ND | ND | ND |
| D2E7-G9-M2.2 DVD-Ig | 1.789 | ND | 4.989 | ND | ND | ND |
| D2E7-G9-M2.3 DVD-Ig | 1.256 | ND | 3.060 | ND | ND | ND |
| D2E7-G9-M2.4 DVD-Ig | 1.312 | ND | 1.903 | ND | ND | ND |
| D2E7-h5C5.8 DVD-Ig | 0.726 | ND | ND | ND | ND | ND |
| D2E7-h5C5.9DVD-Ig | 0.896 | ND | ND | ND | ND | ND |
| D2E7-h5C5.15 DVD-Ig | 0.708 | ND | ND | ND | ND | ND |
| D2E7-10F7 DVD-Ig | 7.2 | ND | 45 | ND | ND | ND |
| D2E7-1D8DVD-Ig | 19 | ND | ND | ND | ND | ND |
| D2E7-5C5 DVD-Ig | 2.6 | ND | 17 | ND | ND | ND |
| D2E7-8B12 DVD-Ig | 14 | ND | ND | ND | ND | ND |
| D2E7-6C6 DVD-Ig | 3.9 | ND | ND | ND | ND | ND |

NI: no inhibition.
ND: not determined.

3.5.4: TNF Neutralization Potency of TNF/IL-17 DVD-Ig Molecules 3.5.4.1: L929 Bioassay for Measuring TNF Neutralization Potency Human TNF Lot No. 1277249 (1.85 mg/mL) was prepared at Abbott Bioresearch Center (Worcester, Mass., US) and received from the Biologics Pharmacy. Mouse TNF Lot 1420095 (1.0 mg/mL) was prepared at Abbott Bioresearch Center and received from the Biologics Pharmacy. Rat TNF Lot 1436667 (3.0 mg/mL) was prepared at Abbott Bioresearch Center and received from the Biologics Pharmacy. Rabbit TNF was purchased from R&D Systems (cat#5670-TG-025). Rhesus/Macaque TNF (rhTNF) was purchased from R&D Systems (cat#1070-RM-025). Actinomycin D (catalog# A1410) was purchased from Sigma Aldrich and resuspended at a stock concentration of 10 mg/mL in DMSO.

Assay Media: 10% FBS (Hyclone#SH30070.03), Gibco reagents: RPMI 1640 (#21870), 2 mM L-glutamine (#25030), 50 units/mL penicillin/50 µg/mL streptomycin (#15140), 0.1 mM MEM non-essential amino acids (#11140) and $5.5 \times 10^{-5}$ M 2-mercaptoethanol (#21985-023).

L929 cells were grown to a semi-confluent density and harvested using 0.05% tryspin (Gibco#25300). The cells were washed with PBS, counted, and resuspended at 1E6 cells/mL in assay media containing 4 µg/mL actinomycin D. The cells were seeded in a 96-well plate (Costar#3599) at a volume of 50 µL and 5E4 cells/well. Wells received 50 µL of assay media, bringing the volume to 100 µL.

A test sample was prepared as follows. The DVD-Ig™ and control IgG were diluted to a 4× concentration in assay media and serial 1:3 dilutions were performed. TNF species were diluted to the following concentrations in assay media: 400 pg/mL huTNF, 200 pg/mL muTNF, 600 pg/mL ratTNF, and 100 pg/mL rabTNF. Antibody sample (200 μL) was added to the TNF (200 μL) in a 1:2 dilution scheme and allowed to incubate for 0.5 h at room temperature.

To measure huTNF neutralization potency of DVD-Ig in this assay, the DVD-Ig/TNF solution was added to the plated cells at 100 μL for a final concentration of DVD-Ig at 375 nM-0.019 nM DVD-Ig. The final concentration of TNF was as follows: 100 pg/mL huTNF, 50 pg/mL muTNF, 150 pg/mL ratTNF, and 25 pg/mL rabTNF. The plates were incubated for 20 h at 37° C., 5% $CO_2$. To quantitate viability, 100 μL was removed from the wells and 10 μL of WST-1 reagent (Roche cat#11644807001) was added. Plates were incubated under assay conditions for 3.5 h, centrifuged at 500×g, and 75 μL of supernatant transferred to an ELISA plate (Costar cat#3369). The plates were read at OD 420-600 nm on a Spectromax 190 ELISA plate reader. The neutralization potency of selected TNF/IL-17 DVD-Ig binding proteins is shown in the table below.

TABLE 38

TNF neutralization potency IC50 (nM)

| | Human TNF | Mouse TNF | Rat TNF | Rabbit TNF | Cyno/Rhesus TNF |
|---|---|---|---|---|---|
| D2E7-B6-5.8 DVD-Ig | 0.015 | >50 | NI | NI | 0.011 |
| D2E7-B6-17.8 DVD-Ig | 0.019 | >50 | NI | NI | 0.016 |
| D2E7-G9-2.8 DVD-Ig | 0.012 | 3.037 | NI | NI | 0.012 |

3.5.5: Affinity Measurement

The binding of TNF/IL-17 DVD-Igs to purified recombinant human, cyno, rat, mouse, rabbit IL-17 and human IL-17A/F as well as to human and cyno/rhesus TNF were determined using surface plasmon resonance as described above (Example 1.5.4)

3.5.6: Pharmacokinetic Analysis of TNF/IL-17 DVD-Ig in Rat

Pharmacokinetic studies with TNF/IL-17 DVD-Ig were carried out in Sprague Dawley rats essentially as described above (Example 2.2.4). Male rats were dosed intravenously or subcutaneously with a single dose of 4 mg/kg of TNF/IL-17 DVD-Ig, and serum samples were analyzed using antigen capture based chemiluminescent MSD (Meso Scale Discovery) method.

Pharmacokinetic parameters were calculated by non-compartmental analysis using WinNonlin. The MSD assay format was essentially the same except that the biotinylated human TNF was used in place of biotinylated human IL-17 for sample incubation.

The pharmacokinetic profile of TNF/IL-17 DVD-Ig is shown in the tables below.

TABLE 40

Subcutaneous injection
D2E7-IL-17-B6-17.8 DVD hIgG1/K

| $T_{1/2}$ (day) | Cmax (μg/mL) | Tmax (day) | % F |
|---|---|---|---|
| 13.2 | 30.1 | 3.0 | 84 |

TABLE 41

Intravenous injection

| DVD Ig | $T_{1/2}$ (day) | Vss (mL/kg) | Cl (ml/hr/kg) |
|---|---|---|---|
| D2E7-B6-17.8 DVD-Ig | 12.9 | 97 | 0.25 |
| D2E7-B6-5.8 DVD-Ig | 9.9 | 77 | 0.23 |
| D2E7-G9-2.8 DVD-Ig | 8.9 | 100 | 0.36 |

3.6: Therapeutic Efficacy of TNF/IL-17 DVD-Ig and Combined TNF and IL-17 Antibodies

TABLE 39

Affinity measurements for TNF/IL-17 DVD-Ig

| | Human IL-17A | Human IL-17A/F | Cyno IL-17A | Rat IL-17A | Mouse IL-17A | Rabbit IL-17A | Human TNF | Cyno/Rhesus TNF |
|---|---|---|---|---|---|---|---|---|
| D2E7-10F7 (M) | 1.17E−09 | 2.16E−09 | 8.49E−10 | 3.55E−09 | 3.90E−09 | ND | ND | ND |
| Kon (l/Ms) | 1.50E+05 | 1.70E+05 | 2.18E+05 | 9.88E+04 | 6.07E+04 | | | |
| Koff (l/s) | 1.75E−04 | 3.67E−04 | 1.85E−04 | 3.51E−04 | 2.37E−04 | | | |
| D2E7-6C6 (M) | 1.06E−09 | 1.78E−09 | 1.78E−09 | 1.21E−08 | 1.45E−08 | ND | ND | ND |
| Kon (l/Ms) | 2.02E+05 | 1.31E+05 | 1.12E+05 | 6.71E+04 | 6.42E+04 | | | |
| Koff (l/s) | 2.15E−04 | 2.33E−04 | 1.99E−04 | 8.11E−04 | 9.31E−04 | | | |
| D2E7-SL-G9 (M) | 8.38E−10 | ND | ND | ND | ND | ND | 5.11E−11 | ND |
| Kon (l/Ms) | 7.40E+04 | | | | | | 3.15E+06 | |
| Koff (l/s) | 6.20E−05 | | | | | | 1.61E−04 | |
| D2E7-GS-G9 (M) | 1.35E−10 | ND | ND | ND | ND | ND | 2.63E−11 | ND |
| Kon (l/Ms) | 7.16E+04 | | | | | | 2.37E+06 | |
| Koff (l/s) | 9.64E−06 | | | | | | 6.24E−05 | |
| D2E7-B6.2 (M) | 4.02E−10 | ND | ND | ND | ND | ND | 6.09E−11 | ND |
| Kon (l/Ms) | 4.92E+04 | | | | | | 2.66E+06 | |
| Koff (l/s) | 1.98E−05 | | | | | | 1.62E−04 | |
| D2E7-B6-17.8 (M) | 4.54E−11 | 5.19E−11 | 7.12E−11 | 3.59E−10 | 5.83E−10 | 2.42E−10 | 1.11E−11 | 1.36E−11 |
| Kon (l/Ms) | 2.80E+05 | 1.88E+05 | 1.70E+05 | 4.60E+04 | 3.36E+04 | 7.30E+04 | 3.15E+06 | 2.02E+06 |
| Koff (l/s) | 1.27E−05 | 9.75E−06 | 1.21E−05 | 1.65E−05 | 1.96E−05 | 1.77E−05 | 3.49E−05 | 2.74E−05 |
| D2E7-B6-5.8 (M) | 3.37E−11 | 5.10E−11 | 1.67E−10 | 1.40E−09 | 2.51E−09 | 3.50E−09 | 9.93E−12 | 1.45E−11 |
| Kon (l/Ms) | 1.67E+05 | 3.63E+05 | 1.74E+05 | 7.27E+04 | 2.31E+04 | 7.69E+04 | 3.04E+06 | 2.06E+06 |
| Koff (l/s) | 5.63E−06 | 1.85E−05 | 2.90E−05 | 1.02E−04 | 5.80E−05 | 2.69E−04 | 3.02E−05 | 2.99E−05 |
| D2E7-G9-2.8 (M) | <3.3E−11 | 4.24E−10 | <3.2E−11 | ND | ND | ND | 3.50E−11 | 7.97E−12 |
| Kon (l/Ms) | 3.00E+04 | 4.50E+04 | 3.09E+04 | | | | 2.14E+06 | 1.58E+06 |
| Koff (l/s) | <1.0E−06 | 1.91E−05 | <1.0E−06 | | | | 7.50E−05 | 1.26E−05 |

ND: not determined 3.6.1: Neutralizing Potency of TNF/IL-17 DVD-Ig in Acute IL-17 Induced KC Model The ability of the TNF/IL-17 DVD-Ig binding proteins to neutralize cytokines in vivo was demonstrated using a mouse model in which recombinant human IL-17 induced the murine chemokine KC. Female BALB/cJ mice were pre-dosed with antibodies intra-peritoneally (i.p.), and 18 hrs later they were injected i.p. with 3 µg rhIL-17 in a 500 µL volume. After 1 hour, the mice were sacrificed, and the levels of KC were assessed by MesoScale. ED50 values for % inhibition of KC were determined and shown in the table below.

TABLE 42

| TNF/IL-17 DVD-Ig | ED50 (mg/kg) rh IL17-induced KC |
| --- | --- |
| D2E7-B6-5.8 DVD-Ig | 7.6 |
| D2E7-B6-17.8 DVD-Ig | 5.2 |
| D2E7-G9-2.8 DVD-Ig | 17.2 |

3.6.2: Neutralizing Potency of TNF/IL-17 DVD-Ig in rhTNF/D-Galactosamine-Induced Lethality Mouse Model The TNF arms of the TNF/IL17 DVD-Ig molecules were also evaluated in the rhTNF/D-galactosamine-induced lethality model. Female C57BL6/N mice were pre-dosed with binding protein (i.p.) and 18 hr later were challenged (i.p.) with 0.1 µg rh TNF and 20 mg D-galactosamine in 500 µL 0.9% sodium chloride and monitored for survival over 48 hours. ED50 values for percent survival were calculated. As shown in the table below, three distinct anti-IL-17/TNF DVD-Ig constructs were tested in these models and all three constructs fully neutralized human IL-17 and human TNF induced bioactivity.

TABLE 43

| TNF/IL-17 DVD-Ig | ED50 (mg/kg) rh TNF/Dgal-induced Lethality |
| --- | --- |
| D2E7-B6-5.8 DVD-Ig | 0.009 |
| D2E7-B6-17.8 DVD-Ig | 0.004 |
| D2E7-G9-2.8 DVD-Ig | 0.028 |

Example 4

Therapeutic Efficacy of IL-17 Antibodies in Mouse Collagen-Induced Arthritis Model The therapeutic effects of anti-IL-17 were evaluated in a collagen-induced arthritis mouse model well known in the art. Briefly, male DBA-1 mice were immunized with bovine type II collagen in CFA at the base of the tail. The mice were boosted with zymosan intraperitoneally (i.p) at day 21. After disease onset at day 24-27, mice were selected and divided into separate groups of 10 mice each. The mean arthritis score of the control group, and anti-cytokine groups was comparable at the start of treatment. Mice were injected (i.p.) every other day with anti-IL-17 mAb MAB421 (12 mg/kg, R&D Systems, Inc., Minneapolis, Minn., US). Mice were carefully examined three times a week for the visual appearance of arthritis in peripheral joints, and scores of disease activity were determined Statistical differences were determined by Student's t-test and p values of <0.05 were considered significant.

Treatment of mice with either anti-IL-17 antibody reduced mean arthritic score (MAS) by 43%, as shown in the table below.

TABLE 44

Inhibition of arthritic score by anti-IL-17 antibody

| Specificity | Antibody treatment | Dose (mg/kg) | % inhibition MAS |
| --- | --- | --- | --- |
| Anti-IL-17 | MAB421 | 12 | 43 |

Example 5

Therapeutic Efficacy of IL-17 Antibodies in Mouse Experimental Autoimmune Encephalomyelitis (EAE) Mode SJL/J mice were immunized using the following protocol for induction of active experimental autoimmune encephalomyelitis (EAE), a model of human multiple sclerosis (MS): stock solutions of 2 mg/ml $PLP_{139-151}$ in PBS and 4 mg/ml $M. tuberculosis$ H37Ra (heat killed and desiccated) in incomplete Freund's adjuvant were combined at 1:1 ratio to give a 1 mg/ml $PLP_{139-151}$ emulsion. Mice were immunized (s.c.) with 0.1 ml of emulsion spread over three sites on the dorsal flank. Mice also receive 60 ng pertussis toxin (i.p.) on of immunization. Mice were dosed (s.c.) with either mouse IgG or anti-mouse IL-17 antibody (MAB421, R&D Systems) on days 7, 14, and 21 post immunization Animals were followed for clinical signs of disease using the following scoring system: 0—normal; 1—loss of tail tone (flaccid); 2—impaired righting reflex, irregular gait; 3—partial hind limb paresis; 4—complete hind limb paralysis; 5—moribund/dead. Animals were euthanized on day 28. The data from this experiment are summarized in the table below. The anti-IL-17 antibody significantly inhibited the clinical course of disease at the 1.5 mg/kg dose tested. The mean maximal score and the mean cumulative score were also affected by this treatment. Anti-IL-17 mAb treatment also significantly inhibited the frequency of disease relapses. These data are consistent will an important role for IL-17 in tissue-specific autoimmune responses in the CNS.

TABLE 45

| | PBS | MAB421 |
| --- | --- | --- |
| Incidence | 15/15 | 13/15 |
| Mean Onset Day* | 10.9 | 10.3 |
| | (+/−1.5) | (+/−1.0) |
| Mean Maximal Score* | 3 | 2.4 |
| | (+/−0.7) | (+/−1.0) |
| Mean Cumulative Score* (onset to conclusion) | 36.3 | 21 |
| | (+/−16.7) | (+/−21.5) |
| Avg Daily Score* | 1.3 | 0.7* |
| | (+/−0.6) | (+/−0.8) |
| Relapse Rate | 9/15 | 3/13 |

*p < 0.05 (students t test vs. PBS

Example 6

Therapeutic Efficacy of Combined TNF and IL-17 Antibodies in Mouse Collagen-Induced Arthritis Model The therapeutic effects of anti-IL-17, anti-TNF, and combined anti-IL-17/anti-TNF were evaluated in a collagen-induced arthritis mouse model well known in the art. Briefly, male DBA-1 mice were immunized with bovine type II collagen in CFA at the base of the tail. The mice were boosted with zymosan intraperitoneally (i.p) at day 21. After disease onset at (day 24-27), mice were selected and divided into separate groups of 12 mice each. The mean arthritis score of the control group, and anti-cytokine groups was comparable at the start of treatment. Mice were injected with anti-IL-17 mAb MAB421 (12 mg/kg), anti-TNF antibody 8C11 (12 mg/kg), or a combination of anti-IL-17/anti-TNF mAbs (12 mg/kg each) i.p, two times a week. Mice were monitored daily for the first week and three times a week subsequently for the visual appearance of arthritis in peripheral joints, and scores of disease activity were determined. Statistical differences were determined by non-parametric Mann-Whitney test and p values of <0.05 were considered significant.

Treatment of mice with either anti-IL-17 or anti-TNF antibodies alone reduced mean arthritic score (MAS) by 43 and 36% respectively, as shown in the table below. Treatment of mice with both anti-IL-17 and anti-TNF monoclonal antibodies further reduced MAS scores to 60% (p<0.05), demonstrating superior efficacy compared to treatment of either monoclonal antibody alone.

TABLE 46

Inhibition of arthritic score by anti-IL-17 and TNF antibodies

| Specificity | Antibody treatment | Dose (mg/kg) | % inhibition MAS |
|---|---|---|---|
| Anti-IL-17 | MAB421 | 12 | 43 |
| Anti-TNF | 8C11 | 12 | 36 |
| Anti-IL-17 + TNF | MAB421 + 8C11 | 24 (12 each) | 60 |

INCORPORATION BY REFERENCE

The present invention incorporates by reference in their entirety techniques well known in the field of molecular biology, drug delivery, immunology, molecular biology and cell biology. These techniques include, but are not limited to, techniques described in the following publications: Ausubel et al. (eds.), Current Protocols in Molecular Biology, John Wiley & Sons, NY (1993); Ausubel, F. M. et al. eds., Short Protocols In Molecular Biology (4th Ed. 1999) John Wiley & Sons, NY. (ISBN 0-471-32938-X). Controlled Drug Bioavailability Drug Product Design and Performance, Smolen and Ball (eds.), Wiley, New York (1984); Giege, R. and Ducruix, A. Barrett, Crystallization of Nucleic Acids and Proteins, a Practical Approach, 2nd ed., pp. 20 1-16, Oxford University Press, New York, N.Y., (1999); Goodson, in Medical Applications of Controlled Release, vol. 2, pp. 115-138 (1984); Hammerling, et al., in: Monoclonal Antibodies and T-Cell Hybridomas 563-681 (Elsevier, N.Y., 1981; Harlow et al., Antibodies: A Laboratory Manual, (Cold Spring Harbor Laboratory Press, 2nd ed. 1988); Kabat et al., Sequences of Proteins of Immunological Interest (National Institutes of Health, Bethesda, Md. (1987) and (1991); Kabat, E. A., et al. (1991) Sequences of Proteins of Immunological Interest, Fifth Edition, U.S. Department of Health and Human Services, NIH Publication No. 91-3242; Kontermann and Dubel eds., Antibody Engineering (2001) Springer-Verlag. New York. 790 pp. (ISBN 3-540-41354-5); Kriegler, Gene Transfer and Expression, A Laboratory Manual, Stockton Press, NY (1990); Lu and Weiner eds., Cloning and Expression Vectors for Gene Function Analysis (2001) BioTechniques Press. Westborough, Mass. 298 pp. (ISBN 1-881299-21-X), Medical Applications of Controlled Release, Langer and Wise (eds.), CRC Pres., Boca Raton, Fla. (1974); Old, R. W. & S. B. Primrose, Principles of Gene Manipulation: An Introduction To Genetic Engineering (3d Ed. 1985) Blackwell Scientific Publications, Boston. Studies in Microbiology; V.2:409 pp. (ISBN 0-632-01318-4); Sambrook, J. et al. eds., Molecular Cloning: A Laboratory Manual (2d Ed. 1989) Cold Spring Harbor Laboratory Press, NY. Vols. 1-3 (ISBN 0-87969-309-6); Sustained and Controlled Release Drug Delivery Systems, J. R. Robinson, ed., Marcel Dekker, Inc., New York, 1978; Winnacker, E. L. From Genes To Clones: Introduction To Gene Technology (1987) VCH Publishers, N.Y. (translated by Horst Ibelgaufts). 634 pp. (ISBN 0-89573-614-4).

Further, the contents of all cited references (including literature references, patents, patent applications, and websites) that maybe cited throughout this application are hereby expressly incorporated by reference in their entirety for any purpose, as are the references cited therein.

EQUIVALENTS

The invention may be embodied in other specific forms without departing from the spirit or essential characteristics thereof. The foregoing embodiments are therefore to be considered in all respects illustrative rather than limiting of the invention described herein. Scope of the invention is thus indicated by the appended claims rather than by the foregoing description, and all changes that come within the meaning and range of equivalency of the claims are therefore intended to be embraced herein.

SEQUENCE LISTING (933 sequences)

SEQ ID NO: 1 - protein, 132 aa, Homo sapiens
GITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 2 - protein, 133 aa, Homo sapiens [sequence omitted]

SEQ ID NO: 3 - protein, 330 aa, Homo sapiens
ASTKGPSVFFLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7 - protein, 30 aa, Homo sapiens
QVQLVQSGAEVKKPGSSVKVSCKASGGTFS

SEQ ID NO: 8 - protein, 14 aa, Homo sapiens
WVRQAPGQGLEWMG

SEQ ID NO: 9 - protein, 32 aa, Homo sapiens
RVTITADKSTSTAYMELSSLRSEDTAVYYCAR

SEQ ID NO: 10 - protein, 11 aa, Homo sapiens
WGQGTLVTVSS

SEQ ID NO: 11 - protein, 11 aa, Homo sapiens
WGQGTMVTVSS

SEQ ID NO: 12 - protein, 11 aa, Homo sapiens
WGQGTTVTVSS

SEQ ID NO: 13 - protein, 23 aa, Homo sapiens
DIQMTQSPSSLSASVGDRVTITC

SEQ ID NO: 14 - protein, 15 aa, Homo sapiens
WYQQKPGKAPKRLIY

SEQ ID NO: 15 - protein, 32 aa, Homo sapiens
GVPSRFSGSGSGTEFTLTISSLQPEDFATYYC

SEQ ID NO: 16 - protein, 23 aa, Homo sapiens
EIVLTQSPDFQSVTPKEKVTITC

SEQ ID NO: 17 - protein, 15 aa, Homo sapiens
WYQQKPDQSPKLLIK

SEQ ID NO: 18 - protein, 32 aa, Homo sapiens
GVPSRFSGSGSGTDFTLTINSLEAEDAATYYC

SEQ ID NO: 19 - protein, 15 aa, Homo sapiens
WYQQKPGKAPKLLIY

SEQ ID NO: 20 - protein, 32 aa, Homo sapiens
GVPSRFSGSGSGTDFTFTISSLQPEDIATYYC

SEQ ID NO: 21 - protein, 23 aa, Homo sapiens
EIVMTQSPATLSVSPGERATLSC

SEQ ID NO: 22 - protein, 15 aa, Homo sapiens
WYQQKPGQAPRLLIY

SEQ ID NO: 23 - protein, 32 aa, Homo sapiens
GIPARFSGSGSGTEFTLTISSLQSEDFAVYYC

SEQ ID NO: 24 - protein, 11 aa, Homo sapiens
FGQGTKLEIKR

SEQ ID NO: 25 - protein, 11 aa, Homo sapiens
FGGGTKVEIKR

SEQ ID NO: 26 - protein, 121 aa, Mus musculus
QVQLQQSGAELVRPGTSVTLSCKASGYRFTDYEIHWIKQTPAQVLEWIGVTDPESGGTLHNPKFDGKATLTADKSSRTAYMELRSLTSEDSAVYYCTRYYKYESFYGMDYWGQGTSVTVSS

SEQ ID NO: 27 - protein, 107 aa, Mus musculus
QIVLTQSPAIMSAFPGEKVTMTCSASSSISYMCWYQQKPGTSPKRWICDTSKLASGVPVRFSGSGSGTSYSLTINSMETEDAATYYCQQRSSYPWTFGGGTKVEIKR

SEQ ID NO: 28 - protein, 119 aa, Mus musculus
QVQLQQSGAELVRPGASVKLSCKASGYTFSDYEIHWVKQTPVHGLAWIGVIHPGNGGTAYNQKFKDKATLTADKSSSTAYMELSSLTSEDSAVYYCERFLTYEGYFDYWGQGTTLTVSS

SEQ ID NO: 29 - protein, 108 aa, Mus musculus
SIVMTQTPKFLLVSAGDRVTITCKASQSVNNDVAWYQHKPGQSPKLLINYASNRYTGVPDRFTGSGYGTDFTFTISTVQAEDLAIYFCQQDYGSPYTFGGGTKLEIKR

SEQ ID NO: 30 - protein, 119 aa, Mus musculus
QVQLQQSGAELVRPGASVKLSCKASGYTFSDYEMHWVKQTPVHGLEWIGVIHPGNGGTAYNQKFRDKATLTADKSSTTAYMELSSLTSEDSAVYYCIRFLTYEGYFDYWGQGTTLTVSS

SEQ ID NO: 31 - protein, 108 aa, Mus musculus
SIVMTQTPKFLLVSAGDRVTITCKASQSVNNDVAWFQHKPGQSPKLLINYASNRYTGVPDRFTGSGYGTDFTFTISTVQSEDLAIYFCQQDYGSPYTFGGGTTLEIKR

SEQ ID NO: 32 - protein, 120 aa, Mus musculus
QVQLKESGPGLVAPSQSLSITCTISGFSLTSYGVHWVRQPPGKGLEWLVVIWSDGTTTYNSALKSRLSITRDNSKSQVFLKMNSLQTDDTAIYYCARDSTWDYYYTMDYWGQGTPVTVSS

SEQ ID NO: 33 - protein, 112 aa, Mus musculus
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVYTFGGGTKLEIKR

SEQ ID NO: 34 - protein, 121 aa, Mus musculus
QVQLQQSGAELVRPGTSVTLSCKASGYIFTDYEIHWVKQTPVHGLEWIGVNDPESGGTFYNQKFDGKAELTADKSSSTAYMELRSLTSEDSGVYYCTRYYRYESFYGMDYWGQGTSITVSS

SEQ ID NO: 35 - protein, 107 aa, Mus musculus
QIVLTQSPAIMSASPGEKVTMTCSASSSISYIYWFQQKPGTSPKRWIYATFELASGVPARFSGSGSGTSYSLTISSMEAEDAATYYCHQRSSYPWTFGGGSKLEIKR

SEQ ID NO: 36 - protein, 119 aa, Mus musculus
QVQLQQSGAELVRPGASVKLSCKALGYTFTDYEFHWVKQTPVHGLEWIGVIHPGNGGTAYNQNFRDKATLTADKSSSTAYMELSSLTSEDSGVYYCTRFLTYEGYFDYWGQGTALTVSS

SEQ ID NO: 37 - protein, 108 aa, Mus musculus
NIVMTQTPKFLLVSPGDRVTITCKASQSVSIDVGWFQQKPGQSPKLLIYHASNRYTGVPDRFTGSGYGTDFTFTVNTVQAEDLAVYFCQQDYSSPYTFGGGTKLELKR

SEQ ID NO: 38 - protein, 118 aa, Mus musculus
QVQLKESGPALVAPSQSLSFTCTISGFSLSSYGVHWVRQPPGKGLEWLVVIWSDGTTTYNSALKSRLSISKDNSKSQVFLKMNSLQTDDTAMYYCARDGYYIYTMDYWGQGTSVTVSS

SEQ ID NO: 39 - protein, 113 aa, Mus musculus
DVVMTQTPLSLPVSLGDQASISCRSSQSLVHSNGNTYLHWYLQRPGQSPKLLIYKVSNRFSGVPDRFSGSGSGTDFTLKISRVEAEDLGLYFCSQGTHAPLTFGAGTKLELNR

SEQ ID NO: 40 - protein, 124 aa, Homo sapiens
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 41 - protein, 111 aa, Homo sapiens
QSGLTQPPSASGTPGQTVSISCSGSNSNIGSHSVNWYQQVPGAAPKLLMYGIGQRPSGVPDRFSVSQSGTSASLAISGLQSEDEADYYCATWDDSLGGYVFGSGTKVTVLG

SEQ ID NO: 42 - protein, 124 aa, Homo sapiens
EVQLLESGGGVVQPGTFLRLSCAATGFTFSAYGMHWVRQAPGRGLEWVAVTSYDGSNKYYADSVKGRFTISRDNSKNTLYLEMNSLRPEDTAVYYCAKVGASGDYYYSYGLDVWGQGTMVTVSS

SEQ ID NO: 43 - protein, 111 aa, Homo sapiens; identical to SEQ ID NO: 41

SEQ ID NO: 44 - protein, 122 aa, Homo sapiens
EVQLVQSGAEVKKPGASVKVSCKASGYTFSDFDIDWVRQATGLGLEWMGWMNPNSGNTGVAPKFRGRVSMTFNTAIRTAYLELSSLRPDDTAVYFCARSSESEGITIGFDNWGQGTLVTVSS

SEQ ID NO: 45 - protein, 109 aa, Homo sapiens
SYELTQPPSVSVSPGQTASIPCSGDKLGNRYACWYKQKPGQPPVLVIYQDNKRPSGISERYSGSNYGDTATLTITGTQAMDEADYYCQTWDSTTGSYVFGTGTKVTVLG

SEQ ID NO: 46 - protein, 126 aa, Homo sapiens
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYTTHHFDYWGQGTPVTVSS

SEQ ID NO: 47 - protein, 108 aa, Homo sapiens
DVVMTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKLDIKR

SEQ ID NO: 48 - protein, 122 aa, Homo sapiens
EVQLVQSGAEVKNPGASVKVSCKVSGSRLSDLAMHWVRQAPGKGPEWMGGFDPDEGETVYAQNFQGRVSMTEDTSSDTAYMELNSLRSEDTAVYYCATIRPWLGGAYYFDNWGQGTLVTVSS

SEQ ID NO: 49 - protein, 108 aa, Homo sapiens
ETTLTQSPAFMSATPGDKVNISCKASQDIDDDMNWYQQKPGEAALFIIQEATTLVPGIPPRFSGSGYGTDFTLTVNNIQSEDAAYYFCLQHDSFPYTFGQGTKLEIKR

SEQ ID NO: 50 - protein, 121 aa, Artificial Sequence
  CDR grafted antibody VH
QVQLVQSGAEVKKPGSSVKVSCKASGGTFSDYEIHWVRQAPGQGLEWMGVNDPESGGTFYNQKFDGRVTITADKSTSTAYMELSSLRSEDTAVYYCARYYRYESFYGMDYWGQGTTVTVSS

SEQ ID NO: 51 - protein, 107 aa, Artificial Sequence
  CDR granfted antibody VL
DIQMTQSPSSLSASVGDRVTITCSASSSISYIYWYQQKPGKAPKRLIYATFELASGVPSRFSGSGSGTEFTLTISSLQPEDFATYYCHQRSSYPWTFGQGTKLEIKR

SEQ ID NO: 52 - protein, 107 aa, Artificial Sequence
  CDR grafted antibody VL
EIVLTQSPDFQSVTPKEKVTITCSASSSISYIYWYQQKPDQSPKLLIKATFELASGVPSRFSGSGSGTDFTLTINSLEAEDAATYYCHQRSSYPWTFGQGTKLEIKR

SEQ ID NO: 53 - protein, 107 aa, Artificial Sequence
  CDR grafted antibody VL
DIQMTQSPSSLSASVGDRVTITCSASSSISYIYWYQQKPGKAPKRLIYATFELASGVPSRFSGSGSGTEFTLTISSLQPEDFATYYCHQRSSYPWTFGGGTKVEIKR

SEQ ID NO: 54 - protein, 107 aa, Artificial Sequence
  CDR grafted antibody VL
EIVLTQSPDFQSVTPKEKVTITCSASSSISYIYWYQQKPDQSPKLLIKATFELASGVPSRFSGSGSGTDFTLTINSLEAEDAATYYCHQRSSYPWTFGGGTKVEIKR

SEQ ID NO: 55 - protein, 119 aa, Artificial Sequence
  CDR grafted antibody VH
QVQLVQSGAEVKKPGSSVKVSCKASGGTFSDYEFHWVRQAPGQGLEWMGVIHPGNGGTAYNQNFRDRVTITADKSTSTAYMELSSLRSEDTAVYYCARFLTYEGYFDYWGQGTLVTVSS

SEQ ID NO: 56 - protein, 108 aa, Artificial Sequence
  CDR grafted antibody VL
DIQMTQSPSSLSASVGDRVTITCKASQSVSIDVGWYQQKPGKAPKLLIYHASNRYTGVPSRFSGSGSGTDFTFTISSLQPEDIATYYCQQDYSSPYTFGQGTKLEIKR

SEQ ID NO: 57 - protein, 108 aa, Artificial Sequence
  CDR grafted antibody VL
DIQMTQSPSSLSASVGDRVTITCKASQSVSIDVGWYQQKPGKAPKLLIYHASNRYTGVPSRFSGSGSGTDFTFTISSLQPEDIATYYCQQDYSSPYTFGGGTKVEIKR

SEQ ID NO: 58 - protein, 108 aa, Artificial Sequence
  CDR grafted antibody VL
EIVMTQSPATLSVSPGERATLSCKASQSVSIDVGWYQQKPGQAPRLLIYHASNRYTGIPARFSGSGSGTEFTLTISSLQSEDFAVYYCQQDYSSPYTFGQGTKLEIKR

SEQ ID NO: 59 - protein, 108 aa, Artificial Sequence
  CDR grafted antibody VL
EIVMTQSPATLSVSPGERATLSCKASQSVSIDVGWYQQKPGQAPRLLIYHASNRYTGIPARFSGSGSGTEFTLTISSLQSEDFAVYYCQQDYSSPYTFGGGTKVEIKR

SEQ ID NO: 60 - protein, 121 aa, Artificial Sequence
  humanized antibody VH
EVQLVQSGAEVKKPGSSVKVSCKASGYTFTDYEIHWVRQAPGQGLEWMGVNDPESGGTFYNQKFDGRVTITADKSTSTAYMELSSLRSEDTAVYYCARYYRYESFYGMDYWGQGTTVTVSS

SEQ ID NO: 61 - protein, 121 aa, Artificial Sequence
  humanized antibody VH
EVQLVQSGAEVKKPGSSVKVSCKASGYTFTDYEIHWVRQAPGQGLEWIGVNDPESGGTFYNQKFDGRATLTADKSTSTAYMELSSLRSEDTAVYYCTRYYRYESFYGMDYWGQGTTVTVSS

SEQ ID NO: 62 - protein, 107 aa, Artificial Sequence
  humanized antibody VL
DIQMTQSPSSLSASVGDRVTITCSASSSISYIYWYQQKPGKAPKRLIYATFELASGVPSRFSGSGSGTDFTLTISSLQPEDFATYYCHQRSSYPWTFGQGTKLEIKR

SEQ ID NO: 63 - protein, 107 aa, Artificial Sequence
  humanized antibody VL
DIQLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR

SEQ ID NO: 64 - protein, 107 aa, Artificial Sequence
  humanized antibody VL
QIVLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR

SEQ ID NO: 65 - protein, 107 aa, Artificial Sequence
  humanized antibody VL
EIVLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR

SEQ ID NO: 66 - protein, 107 aa, Artificial Sequence; identical to SEQ ID NO: 52
  humanized antibody VL

SEQ ID NO: 67 - protein, 107 aa, Artificial Sequence
  humanized antibody VL
EIVLTQSPDFQSVTPKEKVTITCSASSSISYIYWFQQKPDQSPKRWIYATFELASGVPSRFSGSGSGTDYTLTINSLEAEDAATYYCHQRSSYPWTFGQGTKLEIKR

SEQ ID NO: 68 - protein, 107 aa, Artificial Sequence
  humanized antibody VL
QIVLTQSPDFQSVTPKEKVTITCSASSSISYIYWFQQKPDQSPKRWIYATFELASGVPSRFSGSGSGTDYTLTINSLEAEDAATYYCHQRSSYPWTFGQGTKLEIKR

SEQ ID NO: 69 - protein, 119 aa, Artificial Sequence
  humanized antibody VH
EVQLVQSGAEVKKPGASVKVSCKASGYTFTDYEFHWVRQAPGQGLEWMGVIHPGNGGTAYNQNFRDRVTITADKSTSTAYMELSSLRSEDTAVYYCARFLTYEGYFDYWGQGTLVTVSS

SEQ ID NO: 70 - protein, 119 aa, Artificial Sequence
  humanized antibody VH
EVQLVQSGAEVKKPGASVKVSCKASGGTFTDYEFHWVRQAPGQGLEWIGVIHPGNGGTAYNQNFRDRATLTADKSTSTAYMELSSLRSEDTAVYYCTRFLTYEGYFDYWGQGTLVTVSS

SEQ ID NO: 71 - protein, 108 aa, Artificial Sequence
  humanized antibody VL
DIQMTQSPSSLSASVGDRVTITCKASQSVSIDVGWYQQKPGKAPKLLIYHASNRYTGVPSRFSGSGSGTDFTFTISSLQPEDFATYYCQQDYSSPYTFGQGTKLEIKR

SEQ ID NO: 72 - protein, 108 aa, Artificial Sequence
  humanized antibody VL
DIQMTQSPSSLSASVGDRVTITCKASQSVSIDVGWFQQKPGKSPKLLIYHASNRYTGVPSRFSGSGSGTDFTFTISSLQPEDFATYFCQQDYSSPYTFGQGTKLEIKR

SEQ ID NO: 73 - protein, 108 aa, Artificial Sequence
  humanized antibody VL
NIVMTQTPSSLSASVGDRVTITCKASQSVSIDVGWFQQKPGKSPKLLIYHASNRYTGVPSRFSGSGSGTDFTFTISSLQPEDFATYFCQQDYSSPYTFGQGTKLEIKR

SEQ ID NO: 74 - protein, 108 aa, Artificial Sequence
  humanized antibody VL
EIVMTQSPATLSVSPGERATLSCKASQSVSIDVGWYQQKPGQAPRLLIYHASNRYTGIPARFSGSGSGTDFTLTISSLQPEDFAVYYCQQDYSSPYTFGQGTKLEIKR

SEQ ID NO: 75 - protein, 108 aa, Artificial Sequence
  humanized antibody VL
EIVMTQSPATLSVSPGERATLSCKASQSVSIDVGWFQQKPGQSPRLLIYHASNRYTGVPARFSGSGSGTDFTLTISSLQPEDFAVYFCQQDYSSPYTFGQGTKLEIKR

SEQ ID NO: 76 - protein, 108 aa, Artificial Sequence
  humanized antibody VL
NIVMTQTPATLSVSPGERATLSCKASQSVSIDVGWFQQKPGQSPRLLIYHASNRYTGVPARFSGSGSGTDFTLTISSLQPEDFAVYFCQQDYSSPYTFGQGTKLEIKR

SEQ ID NO: 77 - protein, 124 aa, Homo sapiens; identical to SEQ ID NO: 40

SEQ ID NO: 78 - protein, 111 aa, Homo sapiens
QSVLTQPPSASGTPGQTVSISCSGSNSNIGSHSVNWYQQVPGAAPKLLMYGIGQRPSGVPDRFSVSQSGTSASLAISGLQSEDEADYYCATWDDSLGGYVFGSGTKVTVLG

SEQ ID NO: 79 - protein, 124 aa, Artificial Sequence; identical to SEQ ID NO: 40
  VH of affinity matured human IL-17 antibody G9 (identical to parental VH)

SEQ ID NO: 80 - protein, 110 aa, Artificial Sequence
  VL of affinity matured human IL-17 antibody G9 (#1)
QSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVFGSGTKVTVL

SEQ ID NO: 81 - protein, 124 aa, Artificial Sequence
  VH of affinity matured human IL-17 antibody G9 (#2)
EVQLLESGGGVVQPGRSLRLSCAASGFIFSNYGMHWVRQAPGKGLEWVAVISYDGSNAYYADSVKGRFTISRDNSKNTLYLEMNSLRPEDTAVYYCAKVGASGDYYYSYGLDVWGQGTTVTVSS

SEQ ID NO: 82 - protein, 110 aa, Artificial Sequence; identical to SEQ ID NO: 80
  VL affinity matured human IL-17 antibody G9 (#2)

SEQ ID NO: 83 - protein, 124 aa, Artificial Sequence
  VH of affinity matured human IL-17 antibody G9 (#3)
EVQLLESGGGVVQPGRSLRLSCAASGFIFGNYGMHWVRQAPGKGLEWVAVISYDGSNKYYADSVKGRFTISRDNSKNTLYLEMNSPRPEDTAVYYCAKVGASGDYYYSYGLDVWGQGTTVTVSS

SEQ ID NO: 84 - protein, 110 aa, Artificial Sequence
  VL of affinity matured human IL-17 antibody G9 (#3)
QSVLTQPPSASGTPGQTVSISCSGRQSNIGRHYVDWYEQVPGAAPKLLMYYDSIRPSGVPDRFSGSQSGTSASLAISGLQSEDEADYYCGMWDDSLAGYVFGSGTKVTVL

SEQ ID NO: 85 - protein, 124 aa, Artificial Sequence
  VL of affinity matured human IL-17 antibody G9 (#4)
EVQLLESGGGVVQPGRSLRLSCAASGFIFRNYGMHWVRQAPGKGLEWVAVIAYDGSRQYYSDSVKGRFTISRDNSKNTLYLEMNSLRPEDTAVYYCAKVGASGDYYYSYGLDLWGQGTTVTVSS

SEQ ID NO: 86 - protein, 110 aa, Artificial Sequence
  VL of affinity matured human IL-17 antibody G9 (#4)
QSVLTQPPSASGTPGQTVSISCSGRQSNIGRHYVDWYQQVPGAAPKLLMYYDSIRPSGVPDRFSGSQSGTSASLAISGLQSEDEADYYCGMWDDSLAGYVFGSGTKVTVL

SEQ ID NO: 87 - protein, 124 aa, Artificial Sequence
  VH of affinity matured human IL-17 antibody G9 (#5)
EVQLLESGGGVVQPGRSLRLSCAASGFIFSNHGMHWVRQAPGKGLEWVAVIASDGSNKYYADSVKGRFTISRDNSKNTLYLEMNSLRPEDTAVYYCAKVGASGDYYYSYGLDVWGRGTTVTVSS

SEQ ID NO: 88 - protein, 110 aa, Artificial Sequence; identical to SEQ ID NO: 80
  VL of affinity matured human IL-17 antibody G9 (#5)

SEQ ID NO: 89 - protein, 124 aa, Artificial Sequence
  VH of affinity matured human IL-17 antibody G9 (#6)
EVQLLESGGGVVQPGRSLRLSCAASGFIFSNYGMHWVRQAPGKGLEWVAVISYDGSNKYYADSVKGRFTISKDNSKNTLHLEMNSLRPEDTAVYYCAKVGASGDYYYSYGLDVWGQGTTVTVSS

SEQ ID NO: 90 - protein, 110 aa, Artificial Sequence
  VL of affinity matured human IL-17 antibody G9 (#6)
QSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVFGTGTKVTVL

SEQ ID NO: 91-99 - skipped (9 entries)

SEQ ID NO: 100 - protein, 124 aa, Artificial Sequence; identical to SEQ ID NO: 40
  VH of affinity matured human IL-17 antibody G9 (#7)

SEQ ID NO: 101 - protein, 110 aa, Artificial Sequence; identical to SEQ ID NO: 90
  VL of affinity matured human IL-17 antibody G9 (#7)

SEQ ID NO: 102 - protein, 124 aa, Artificial Sequence
  VH of affinity matured human IL-17 antibody G9 (#8)
EVQLLESGGGVVQPGRSLRLSCAASGFIFSNYGMHWVRQAPGKGLEWVAVISYDGSNKYYADSVKGRFTISRDNSKNTLYLEMNSLRPKDTAVYYCAKVGASGDYYYSYGLDVWGQGTTVTVSS

SEQ ID NO: 103 - protein, 110 aa, Artificial Sequence; identical to SEQ ID NO: 90
  VL of affinity matured human IL-17 antibody G9 (#8)

SEQ ID NO: 104 - protein, 124 aa, Artificial Sequence
  VH of affinity matured human IL-17 antibody G9 (#9)
EVQLLESGGGVVQPGRSLRLSCAASGFIFSNYGMHWVRQAPGKGLEWVAVISFDGSNKYYPDSVKGRFTISRDNSKNTLYLEMNSLRPEDTAVYYCAKVGASGDYYYSYGLDVWGQGTTVTVSS

SEQ ID NO: 105 - protein, 110 aa, Artificial Sequence
  VL of affinity matured human IL-17 antibody G9 (#9)
QSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVLGTGTKVTVL

SEQ ID NO: 106 - protein, 124 aa, Artificial Sequence
  VH of affinity matured human IL-17 antibody G9 (#10)
EVQLLESGGGVVQPGRSLRLSCAASGFIFTNYGMHWVRQAPGKGLEWVAVISFDGSNRYYADSVKGRFTISRDNSKNTLYLEMNSLRPEDTAVYYCAKVGASGDYYYSYGLDVWGQGTTVTVSS

SEQ ID NO: 107 - protein, 110 aa, Artificial Sequence; identical to SEQ ID NO: 90
  VL of affinity matured human IL-17 antibody G9 (#10)

SEQ ID NO: 108 - protein, 124 aa, Artificial Sequence
  VH of affinity matured human IL-17 antibody G9 (#11)
EVQLLESGGGVVQPGRSLRLSCAASGFIFSNYGMHWVRQAPGKGLEWVAVISYDGRNKYYEDSVKGRFTISRDNSKNTLYLEMNSLRPEDTAVYYCAKVGASGDYYYSYGLDVWGQGTTVTVSS

SEQ ID NO: 109 - protein, 110 aa, Artificial Sequence
  VL of affinity matured human IL-17 antibody G9 (#11)
QSVLTQPPSASGTPGQTVSISCSGRQSNIGRHYVDWYQQVPGAAPKLLMYYDSIRPSGVPDRFSGSQSGTSASLVISGLQSEDEADYYCATWDDSLGGYVFGTGTKVTVL

SEQ ID NO: 110 - protein, 124 aa, Artificial Sequence
  VH of affinity matured human IL-17 antibody G9 (#12)
EVQLLESGGGVVQPGRSLRLSCAASGFIFRNYGMHWVRQAPGKGLEWVAVISYDGRNKYYTDSVKGRFTISRDNSKNTLYLEMNSLRPEDTAVYYCAKVGASGDYYYSYGLDVWGQGTTVTVSS

SEQ ID NO: 111 - protein, 110 aa, Artificial Sequence; identical to SEQ ID NO: 80
  VL of affinity matured human IL-17 antibody G9 (#12)

SEQ ID NO: 112 - protein, 124 aa, Artificial Sequence
  VH of affinity matured human IL-17 antibody G9 (#13)
EVQLLESGGGVVQPGRSLRLSCAASGFIFRNYGMHWVRQAPGKGLEWVAVISYDGTNTYYADSVKGRFTISRDNSKNTLYLEMNSLRPEDTAVYYCAKVGASGDYYYSYGLDVWGQGTTVTVSS

SEQ ID NO: 113 - protein, 110 aa, Artificial Sequence; identical to SEQ ID NO: 90
  VL of affinity matured human IL-17 antibody G9 (#13)

SEQ ID NO: 114 - protein, 124 aa, Artificial Sequence
  VH of affinity matured human IL-17 antibody G9 (#14)
EVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 115 - protein, 110 aa, Artificial Sequence; identical to SEQ ID NO: 90
  VL of affinity matured human IL-17 antibody G9 (#14)

SEQ ID NO: 116 - protein, 124 aa, Artificial Sequence
  VH of affinity matured human IL-17 antibody G9 (#15)
EVQLLESGGGVVQPGRSLRLSCAASGFIFSNYGMHWVRQAPGKGLEWVAVISNDGSNTYYADSVKGRFTISRDNSENTLYLEMNSLRPEDTAVYYCAKVGASGDYYYSYGLDVWGQGTTVTVSS

SEQ ID NO: 117 - protein, 110 aa, Artificial Sequence
  VL of affinity matured human IL-17 antibody G9 (#15)
QSVLTQPPSASGTPGQTVSISCSGRQSNIGRHYVDWYQQVPGAAPKLLMYYDSIRPSGVPDRFSGSQSGTSASLAISGLQSEDEADYYCATWDDWLAGYVFGTGTKVTVL

SEQ ID NO: 118 - protein, 124 aa, Artificial Sequence; identical to SEQ ID NO: 40
  VH of affinity matured human IL-17 antibody G9 (#16)

SEQ ID NO: 119 - protein, 110 aa, Artificial Sequence
  VL of affinity matured human IL-17 antibody G9 (#16)
QSVLTQPPSASGTPGQTVSISCSGRQSNIGRHYVDWYQQVPGAAPKLLMYYDSIRPSGVPDRFSGSQSGTSASLAISGLQSEDEADYYCATWDDFLAGYVFGTGTKVTVL

SEQ ID NO: 120 - protein, 124 aa, Artificial Sequence; identical to SEQ ID NO: 40
  VH of affinity matured human IL-17 antibody G9 (#17)

SEQ ID NO: 121 - protein, 110 aa, Artificial Sequence
  VL of affinity matured human IL-17 antibody G9 (#17)
QSVLSQPPSASGTPGQTVSISCSGTNSNIGRHAVDWYQQVPGAAPKLLMYYDSIRPSGVPDRFSGSQSGTSASLAISGLQSEDEADYYCATWDDSLGGYVFGTGTKVTVL

SEQ ID NO: 122 - protein, 124 aa, Artificial Sequence
  VH of affinity matured human IL-17 antibody G9 (#18)
EVQLLESGGGVVQPGRSLRLSCAASGFIFRNNGMHWVRQAPGKGLEWVAVISRDGSNKYYADSVKGRFTISRDNSKNTLYLEMNRLRPEDTAVYYCAKVGASGDYYYSYGLDVWGQGTTVTVSS

SEQ ID NO: 123 - protein, 110 aa, Artificial Sequence
  VL of affinity matured human IL-17 antibody G9 (#18)
QSVLTQPPSASGTPGQTVSISCSGRQSNIGNHYVDWYQQVPGAAPKLLIYGDVIRPSGVPDRFSGSQSGTSASLAISGLQSEDEADYYCATWDDWLAGYVFGTGTKVTVL

SEQ ID NO: 124 - protein, 124 aa, Artificial Sequence
  VH of affinity matured human IL-17 antibody G9 (#19)
EVQLLESGGGVVQPGRSLRLSCAASGFIFSNYGMHWVRQAPGKGLEWVAVISYDGSNSYYADSVKGRFTISRDNSKNTLYLEMNSLRPEDTAVYYCAKVGASGDYYYSYGLDVWGQGTTVTVSS

SEQ ID NO: 125 - protein, 124 aa, Artificial Sequence; identical to SEQ ID NO: 122
  VL of affinity matured human IL-17 antibody G9 (#19)

SEQ ID NO: 126 - protein, 124 aa, Artificial Sequence
  VH of affinity matured human IL-17 antibody G9 (#20)
EVQLLESGGGVVQPGRSLRLSCAASGFIFSDYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 127 - protein, 110 aa, Artificial Sequence
  VL of affinity matured human IL-17 antibody G9 (#20)
QSVLTQPPSASGTPGQTVSISCSGRQSNIGNHYVDWYQQVPGAAPKLLIYGDVIRPSGVPDRFSGSQSGTSASLAISGLQSEDEADYYCATWDDWLAGYVFGSGTKVTVL

SEQ ID NO: 128 - protein, 124 aa, Artificial Sequence
  VH of affinity matured human IL-17 antibody G9 (#21)
EVQLLESGGGVVQPGRSLRLSCAASGFIFSNYGMHWVRQAPGKGLEWVAVISNDGSNKYYSDSVKGRFTISRDNSKNTLYLEMNSLRPEDTAVYYCAKVGASGDYYYSYGLDVWGQGTTVTVSS

SEQ ID NO: 129 - protein, 110 aa, Artificial Sequence
  VL of affinity matured human IL-17 antibody G9 (#21)
QSGLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGTGTKVTVL

SEQ ID NO: 130 - protein, 124 aa, Artificial Sequence
  VH of affinity matured human IL-17 antibody G9 (#22)
EVQLLESGGGVVQPGRSLRLSCAASGFIFSNYGMHWVRQAPGKGLEWVAVISNDGGNKYYADSVKGRFTISRDNSKNTLYLEMNSLRPEDTAVYYCAKVGASGDYYYSYGLDVWGQGTTVTVSS

SEQ ID NO: 131 - protein, 110 aa, Artificial Sequence
  VL of affinity matured human IL-17 antibody G9 (#22)
QSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGTGTKVTVL

SEQ ID NO: 132 - protein, 124 aa, Artificial Sequence; identical to SEQ ID NO: 114
  VH of affinity matured human IL-17 antibody G9 (#23)

SEQ ID NO: 133 - protein, 110 aa, Artificial Sequence; identical to SEQ ID NO: 131
  VL of affinity matured human IL-17 antibody G9 (#23)

SEQ ID NO: 134 - protein, 124 aa, Artificial Sequence
  VH of affinity matured human IL-17 antibody G9 (#24)
EVQLLESGGGVVQPGRSLRLSCAASGFIFGNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 135 - protein, 110 aa, Artificial Sequence; identical to SEQ ID NO: 131
  VL of affinity matured human IL-17 antibody G9 (#24)

SEQ ID NO: 136 - protein, 124 aa, Artificial Sequence
  VH of affinity matured human IL-17 antibody G9 (#25)
EVQLLESGGGVVQPGRSLRLSCAASGFIFNNHGMHWVRQAPGKGLEWVAVISYDGWNKYYADSVKGRFTISRDNSKNTLYLEMNSLRPEDTAVYYCAKVGASGDYYYSYGLDVWGQGTTVTVSS

SEQ ID NO: 137 - protein, 110 aa, Artificial Sequence; identical to SEQ ID NO: 131
  VL of affinity matured human IL-17 antibody G9 (#25)

SEQ ID NO: 138 - protein, 124 aa, Artificial Sequence
  VH of affinity matured human IL-17 antibody G9 (#26)
EVQLLESGGGVVQPGRSLRLSCGASGFIFRNYGMHWVRQAPGKGLEWVAVISYDGTSKYYADSVKGRFTISRDNSKNTLYLEMNSLRPEDTAVYYCAKVGASGDYYYSYGLDVWGQGTTVTVSS

SEQ ID NO: 139 - protein, 110 aa, Artificial Sequence
  VL of affinity matured human IL-17 antibody G9 (#26)
QSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVL

SEQ ID NO: 140 - protein, 124 aa, Artificial Sequence
  VH of affinity matured human IL-17 antibody G9 (#27)
EVQLLESGGGVVQPGRSLRLSCAASGFIFPNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 141 - protein, 110 aa, Artificial Sequence; identical to SEQ ID NO: 131
  VL of affinity matured human IL-17 antibody G9 (#27)

SEQ ID NO: 142 - protein, 124 aa, Artificial Sequence; identical to SEQ ID NO: 40
  VH of affinity matured human IL-17 antibody G9 (#28)

SEQ ID NO: 143 - protein, 110 aa, Artificial Sequence
  VL of affinity matured human IL-17 antibody G9 (#28)
QSVLTQPPSASGTPGQTVSISCSGRPSNIGSHAVDWYQQVPGAAPKLLMYYTDLRPSGVPDRFSGSQSGTSASLAISGLQSEDEADYYCATWDDHLAGYVFGTGTKVTVL

SEQ ID NO: 144 - protein, 124 aa, Artificial Sequence
  VH of affinity matured human IL-17 antibody G9 (#29)
EVQLLESGGGVVQPGRSLRLSCAASGFIFSNYGMHWVRQAPGKGLEWVAVISCDGRNKYYADSVKGRFTISRDNSKNTLYLEMNSLRPEDTAVYYCAKVGASGNYYYSYGLDVWGQGTTVTVSS

SEQ ID NO: 145 - protein, 110 aa, Artificial Sequence
  VL of affinity matured human IL-17 antibody G9 (#29)
QSVLTQPPSASGTPGQTVSISCSGRNSNIGYHTVDWYQQVPGAAPKLLMYYSVQRPSGVPDRFSGSQSGTSASLAISGLQSEDEADYYCASWDDSLGGYVFGTGTKVTVL

SEQ ID NO: 146 - protein, 124 aa, Artificial Sequence
  VH of affinity matured human IL-17 antibody G9 (#30)
EVQLLESGGGVVQPGRSLRLSCAASGFIFSNYGMHWVRQAPGKGLEWVAVISYDGSNRYYADSVKGRFTISRDNSKNTLYLEMNSLRPEDTAVYYCAKVGASGDYYYSYGLDVWGQGTTVTVSS

SEQ ID NO: 147 - protein, 110 aa, Artificial Sequence
  VL of affinity matured human IL-17 antibody G9 (#30)
QSVLTQPPSASGTPGQTVSISCSGRNSNIGNHPVDWYQQVPGAAPKLLMYYTGIRPSGVPDRFSGSQSGTSASLAISGLQSEDEADYYCASWDDRLGGYVFGTGTKVTVL

SEQ ID NO: 148 - protein, 124 aa, Artificial Sequence
  VH of affinity matured human IL-17 antibody G9 (#31)
EVQLLESGGGVVQPGRSLRLSCAASGFIFSNYGMHWVRQAPGKGLEWVAVIAYDGSNKYYADSVKGRFTISRDNSKNTLYLEMNSLRPEDTAVYYCAKVGASGDYYYSYGLDVWGQGTTVTVSS

SEQ ID NO: 149 - protein, 110 aa, Artificial Sequence
  VL of affinity matured human IL-17 antibody G9 (#31)
QSVLTQPPSASGTPGQTVSISCSGGKSNIGSHPVDWYQQVPGAAPKLLMYYVGMRPSGVPDRFSGSQSGTSASLAISGLQSEDEADYYCATWDDSLAGYVFGTGTKVTVL

SEQ ID NO: 150 - protein, 124 aa, Artificial Sequence; identical to SEQ ID NO: 40
  VH of affinity matured human IL-17 antibody G9 (#32)

SEQ ID NO: 151 - protein, 110 aa, Artificial Sequence
  VL of affinity matured human IL-17 antibody G9 (#32)
QSVLTQPPSASGTPGQTVSISCSGRNSNIGNHYVDWYQQVPGAAPKLLIYGTGSRPSGVPDRFSGSQSGTSASLAISGLQSEDEADYYCATWDDWLAEYVFGTGTKVTVL

SEQ ID NO: 152 - protein, 124 aa, Artificial Sequence
  VH of affinity matured human IL-17 antibody G9 (#33)
EVQLLESGGGVVQPGRSLRLSCAASGFIFSNNGMHWVRQAPGKGLEWVAVISSDGSHGYYADSVKGRFTISRDNSKNTLYLEMNSLRPEDTAVYYCAKVGASGDYYYSYGLDVWGQGTTVTVSS

SEQ ID NO: 153 - protein, 110 aa, Artificial Sequence
  VL of affinity matured human IL-17 antibody G9 (#33)
QSVLTQPPSASGTPGQTVSISCSGRMSNIGYHSVDWYQQVPGAAPKLLIYGISQRPSGVPDRFSGSQSGTSASLAISGLQSEDEADYYCATWDDWLAGYVFGTGTKVTVL

SEQ ID NO: 154 - protein, 124 aa, Artificial Sequence
  VH of affinity matured human IL-17 antibody G9 (#34)
EVQLLESGGGVVQPGRSLRLSCAASGFIFSNNGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 155 - protein, 110 aa, Artificial Sequence
  VL of affinity matured human IL-17 antibody G9 (#34)
QSVLTQPPSASGTPGQTVSISCSGRSSNIGNHSVDWYQQVPGAAPKLLMYGIGQRPSGVPDRFSVSQSGTSASLAISGLQSEDEADYYCATWDDWLGGYVFGTGTKVTVL

SEQ ID NO: 156 - protein, 124 aa, Artificial Sequence
  VH of affinity matured human IL-17 antibody G9 (#35)
EVQLLESGGGVVQPGRSLRLSCAASGFIFNNHGMHWVRQAPGKGLEWVAVISYDGSNKYYADSVKGRFTISRDNSKNTLYLEMNSLRPEYTAVYYCAKVGASGDYYYSYGLDVWGQGTTVTVSS

SEQ ID NO: 157 - protein, 110 aa, Artificial Sequence
  VL of affinity matured human IL-17 antibody G9 (#35)
QSVLTQPPSASGTPGQTVSISCSGRSSNIGCHAVDWYQQVPGAAPKLLMYGISERPSGVPDRFSGSQSGTSASLAISGLQSEDEADYYCATWDDRLAAYVFGTGTKVTVL

SEQ ID NO: 158 - protein, 124 aa, Artificial Sequence; identical to SEQ ID NO: 40
  VH of affinity matured human IL-17 antibody G9 (#36)

SEQ ID NO: 159 - protein, 110 aa, Artificial Sequence
  VL of affinity matured human IL-17 antibody G9 (#36)
QSVLTQPPSASGTPGQTVSISCSGRISNIGNHAVDWYQQVPGAAPKLLMYGIGQRPSGVPDRFSGSQSGTSASLAISGLQSEDEADYYCATWDDWLAGYVFGSGTKVTVL

SEQ ID NO: 160 - protein, 124 aa, Artificial Sequence
  VH of affinity matured human IL-17 antibody G9 (#37)
EVQLLESGGGVVQPGRSLRLSCAASGFIFSYHGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 161 - protein, 110 aa, Artificial Sequence
  VL of affinity matured human IL-17 antibody G9 (#37)
QSVLTQPPSASGTPGQTVSISCSGRNSNIGNHSVYWYQQVPGAAPKLLMYESDQRPSGVPDRFSGSQSGTSASLAISGLQSEDEADYYCATWDDWLGVYVFGSGTKVTVL

SEQ ID NO: 162 - protein, 124 aa, Artificial Sequence; identical to SEQ ID NO: 40
  VH of affinity matured human IL-17 antibody G9 (#38)

SEQ ID NO: 163 - protein, 110 aa, Artificial Sequence
  VL of affinity matured human IL-17 antibody G9 (#38)
QSVLTQPPSASGTPGQTVSISCSGRRSNIGYHSVDWYQQVPGAAPKLLMYGDDQRPSGVPDRFSGSQSGTSASLAISGLQSEDEADYYCATWDDWLGGYVFGTGTKVTVL

SEQ ID NO: 164 - protein, 124 aa, Artificial Sequence
  VH of affinity matured human IL-17 antibody G9 (#39)
EVQLLESGGGVVQPGRSLRLSCAASGFIFNNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 165 - protein, 110 aa, Artificial Sequence
  VL of affinity matured human IL-17 antibody G9 (#39)
QSVLTQPPSASGTPGQTVSISCSGRNSNIGNHSVDWYQQVPGAAPKLLMYWSGHRPSGVPDRFSGSQSGTSASLAISGLQSEDEADYYCATWDDRLGGYVFGTGTKVTVL

SEQ ID NO: 166 - protein, 124 aa, Artificial Sequence
  VH of affinity matured human IL-17 antibody G9 (#40)
EVQLLESGGGVVQPGRSLRLSCAASGFIFRNYGMHWVRQAPGKGLEWVAVISRDGSGKYYADSVKGRFTISRDNSKNTLYLEMNSLRPEDTAVYYCAKVGASGDYYYSYGLDVWGQGTTVTVSS

SEQ ID NO: 167 - protein, 110 aa, Artificial Sequence
  VL of affinity matured human IL-17 antibody G9 (#40)
QSVLTQPPSASGTPGQTVSISCSGTNSNIGNHSVDWYQQVPGAAPKLLMYGVGERPSGVPDRFSGSQSGTSASLAISGLQSEDEADYYCATWDDRLGGYVFGTGTKVTVL

SEQ ID NO: 168 - protein, 124 aa, Artificial Sequence; identical to SEQ ID NO: 164
  VH of affinity matured human IL-17 antibody G9 (#41)

SEQ ID NO: 169 - protein, 110 aa, Artificial Sequence
  VL of affinity matured human IL-17 antibody G9 (#41)
QSVLTQPPSASGTPGQTVSISCSGRNSNIGSHSVDWYQQVPGAAPKLLMYYNGQRPSGVPDRFSGSQSGTSASLAISGLQSEDEADYYCATWDDWLGGYVFGSGTKVTVL

SEQ ID NO: 170 - protein, 124 aa, Artificial Sequence
  VH of affinity matured human IL-17 antibody G9 (#42)
EVQLLESGGGVVQPGRSLRLSCAASGFIFSNYGMHWVRQAPGKGLEWVAVISYDGSKQYYADSVKGRFTISRDNSKDTLYLEMNSLRPEDTAVYYCAKVGASGDYYYSYGLDVWGQGTTVTVSS

SEQ ID NO: 171 - protein, 110 aa, Artificial Sequence
  VL of affinity matured human IL-17 antibody G9 (#42)
QSVLTQPPSASGTPGQTVSISCSGRNSNIGSHSVDWYQQVPGAAPKLLMYYNGHRPSGVPDRFSGSQSGTSASLAISGLQSEDEADYYCATWDDWLGGYVFGTGTKVTVL

SEQ ID NO: 172 - protein, 124 aa, Artificial Sequence
  VH of affinity matured human IL-17 antibody G9 (#43)
EVQLLESGGGVVQPGRSLRLSCAASGFIFGHYGMHWVRQAPGKGLEWVAVISYDGRNQYYVDSVKGRFTISRDNSKNTLYLEMNSLRPEDTAVYYCAKVGASGDYYYSYGLDVWGQGTTVTVSS

SEQ ID NO: 173 - protein, 110 aa, Artificial Sequence
  VL of affinity matured human IL-17 antibody G9 (#43)
QSVLTQPPSASGTPGQTVSISCSGRTSNIGRHFVDWYQQVPGAAPKLLMYYGDMRPSGVPDRFSGSQSGTSASLAISGLQSEDEADYYCATWDDSLGGYVFGSGTKVTVL

SEQ ID NO: 174 - protein, 124 aa, Artificial Sequence
  VH of affinity matured human IL-17 antibody G9 (#44)
EVQLLESGGGVVQPGRSLRLSCAASGFIFSNYGMHWVRQAPGKGLEWVAVISYDGTNKYYRDSVKGRFTISRDNSKNTLYLEMNSLRPEDTAVYYCAKVGALGDYYYTYGLDVWGQGTTVTVSS

SEQ ID NO: 175 - protein, 110 aa, Artificial Sequence
  VL of affinity matured human IL-17 antibody G9 (#44)
QSVLTQPPSASGTPGQTVSISCSGSKSNIGRHSVDWYQQVPGAAPKLLMYYSDMRPSGVPDRFSGSQSGTSASLAISGLQSEDEADYYCATWDDSLGGYVFGTGTKVTVL

SEQ ID NO: 176 - protein, 124 aa, Artificial Sequence
  VH of affinity matured human IL-17 antibody G9 (#45)
EVQLLESGGGVVQPGRSLRLSCAASGFIFSNYGMHWVRQAPGKGLEWVAVISYDGSRGYYADSVKGRFTISRDNSKNTLYLEMNSLRPEDTAVYYCAKVGASGDYYYSYGLDVWGQGTTVTVSS

SEQ ID NO: 177 - protein, 110 aa, Artificial Sequence
  VL of affinity matured human IL-17 antibody G9 (#45)
QSVLTQPPSASGTPGQTVSISCSGSRSNIGRHCVDWYQQVPGAAPKLLIYFDDLRPSGVPDRFSGSQSGTSASLAISGLQSEDEADYYCATWDDRLAGYVFGSGTKVTVL

SEQ ID NO: 178 - protein, 124 aa, Artificial Sequence
  VH of affinity matured human IL-17 antibody G9 (#46)
EVQLLESGGGMVQPGRSLRLSCAASGFIFSNYGMHWVRQAPGKGLEWVAVIAYDGSRKYYADSVKGRFTISRDNSKNTLYLEMNSLRPEDTAVYYCAKVGASGDYYYSYGLDVWGQGTTVTVSS

SEQ ID NO: 179 - protein, 110 aa, Artificial Sequence
  VL of affinity matured human IL-17 antibody G9 (#46)
QSVLTQPPSASGTPGQTVSISCSGSHSNIGRHSVDWYQQVPGAAPKLLMYFTDYRPSGVPDRFSGSQSGTSASLAISGLQSEDEADYYCATWDDLLAGYVFGTGTKVTVL

SEQ ID NO: 180 - protein, 124 aa, Artificial Sequence
  VH of affinity matured human IL-17 antibody G9 (#47)
EVQLLESGGGVVQPGRSLRLSCAASGFIFNNYGMHWVRQAPGKGLEWVAVISMDGSRKYYADSVKGRFTISRDNSKNTLYLEMNSLRPEDTAVYYCAKVGASGDYYYSYGLDVWGQGTTVTVSS

SEQ ID NO: 181 - protein, 110 aa, Artificial Sequence
  VL of affinity matured human IL-17 antibody G9 (#47)
QSVLTQPPSASGTPGQTVSISCSGSPSNIGRHYVHWYQQVPGAAPKLLMYFTDQRPSGVPDRFSGSQSGTSASLAISGLQSEDETDYYCATWDDSLGGYVFGSGTKVTVL

SEQ ID NO: 182 - protein, 124 aa, Artificial Sequence
  VH of affinity matured human IL-17 antibody G9 (#48)
EVQLLESGGGVVQPGRSLRLSCAASGFIFTNYGMHWVRQAPGKGLEWVAVISSDGSNKYYADSVKGRFTISRDNSKNTLYLEMNSLRPEDTAVYYCAKVGASGDYYYSYGLDVWGQGTTVTVSS

SEQ ID NO: 183 - protein, 110 aa, Artificial Sequence
  VL of affinity matured human IL-17 antibody G9 (#48)
QSVLTQPPSASGTPGQTVSISCSGSNSNIGSHYVDWYQQVPGAAPKLLMYYGGYRPSGVPDRFSGSQSGTSASLAISGLQSEDEADYYCATWDDSLGGYVFGTGTKVTVL

SEQ ID NO: 184 - protein, 124 aa, Artificial Sequence
  VH of affinity matured human IL-17 antibody G9 (#49)
EVQLLESGGGVVQPGRSLRLSCAASGFIFRDYGMHWVRQAPGKGLEWVAVISNDGWNKYYADSVKGRFTISRDNSKNTLYLEMNSLRPEDTAVYYCAKVGASGDYYYSYGLDVWGQGTTVTVSS

SEQ ID NO: 185 - protein, 110 aa, Artificial Sequence
  VL of affinity matured human IL-17 antibody G9 (#49)
QSVLTQPPSASGTPGQTVSISCSGSKSNIGSHAVDWYQQVPGAAPKLLMYYGGYRPSGVPDRFSGSQSGTSASLAISGLQSEDEADYYCATWDDSLGGYVFGSGTKVTVL

SEQ ID NO: 186 - protein, 124 aa, Artificial Sequence; identical to SEQ ID NO: 40
  VH of affinity matured human IL-17 antibody G9 (#50)

SEQ ID NO: 187 - protein, 110 aa, Artificial Sequence
  VL of affinity matured human IL-17 antibody G9 (#50)
QSVLTQPPSASGTPGQTVSISCSGSNSNIGGHYVDWYQQVPGAAPKLLMYYTGYRPSGVPDRFSGSQSGTSASLAISGLQSEDEADYYCATWDDSLGAYVFGTGTKVTVL

SEQ ID NO: 188 - protein, 124 aa, Artificial Sequence
  VH of affinity matured human IL-17 antibody G9 (#51)
EVQLLESGGGVVQPGRSLRLSCAASGFIFSNYGMHWVRQAPGKGLEWVAVISYDGSNKYYADSVKGRFTISRDNPKNTLYLEMNSLRPEDTAVYYCAKVGASGDYYYSYGLDVWGQGTTVTVSS

SEQ ID NO: 189 - protein, 110 aa, Artificial Sequence
  VL of affinity matured human IL-17 antibody G9 (#51)
QSVLTQPPSASGTPGQTVSISCSGTNSNIGSHSVDWYQQVPGAAPKLLMYYTGYRPSGVPDRFSGSQSGTSASLAISGLQSEDEADYYCATWDDSLGGYVFGSGTKVTVL

SEQ ID NO: 190 - protein, 124 aa, Artificial Sequence
  VH of affinity matured human IL-17 antibody G9 (#52)
EVQLLESGGGVVQPGRSLRLSCAASGFIFSNYGMHWVRQAPGKGLEWVAVISSDGSNKYYSDSVKGRFTISRDNSKNTLYLEMNSLRPEDTAVYYCAKVGASGDYYYSYGLDVWGQGTTVTVSS

SEQ ID NO: 191 - protein, 110 aa, Artificial Sequence
  VL of affinity matured human IL-17 antibody G9 (#52)
QSVLTQPPSASRTPGQTVSISCSGNNSNIGTHYVDWYQQVPGAAPKLLMYYTGYRPSGVPDRFSGSQSGTSASLAISGLQSEDEADYYCATWDDSLGGYVFGSGTKVTVL

SEQ ID NO: 192 - protein, 124 aa, Artificial Sequence
  VH of affinity matured human IL-17 antibody G9 (#53)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYRAKVGASGDYYYSYGLDVWGQGTTVTVSS

SEQ ID NO: 193 - protein, 110 aa, Artificial Sequence
  VL of affinity matured human IL-17 antibody G9 (#53)
QSVLTQPPSASGTPGQTVSISCSGTNSNIGRHYVDWYQQVPGAAPKLLMYFGGYRPSGVPDRFSGSQSGTSASLAISGLQSEDEADYYCATWDDSLGGYVFGSGTKVTVL

SEQ ID NO: 194 - protein, 124 aa, Artificial Sequence; identical to SEQ ID NO: 40
  VH of affinity matured human IL-17 antibody G9 (#54)

SEQ ID NO: 195 - protein, 110 aa, Artificial Sequence
  VL of affinity matured human IL-17 antibody G9 (#54)
QSVLTQPPSASGTPGQTVSISCSGSHSNIGRHPVDWYQQVPGAAPKLLMYYGGYRPSGVPDRFSGSQSGTSASLAISGLQSEDEADYYCATWDDSLGGYVFGSGTKVTVL

SEQ ID NO: 196 - protein, 124 aa, Artificial Sequence
  VH of affinity matured human IL-17 antibody G9 (#55)
EVQLLESGGGVVQPGRSLRLSCAASGFIFSNYGMHWVRQAPGKGMEWVAVISYDGSNKYYADSVKGRFTISRDNSKNTLYLEMNSLRPEDTAVYYCAKVGASGDYYYSYGLDAWGQGTTVTVSS

SEQ ID NO: 197 - protein, 110 aa, Artificial Sequence
  VL of affinity matured human IL-17 antibody G9 (#55)
QSVLTQPPSASGTPGQTVSISCSGSHSNIGSHPVDWYQQVPGAAPKLLMYYSVYRPSGVPDRFSGSQSGTSASLAISGLQSEDEADYYCATWDDSLGGYVFGSGTKVTVL

SEQ ID NO: 198 - protein, 124 aa, Artificial Sequence
  VH of affinity matured human IL-17 antibody G9 (#56)
EVQLLESGGGVVQPGRSLRLSCAASGFIFSNYGMHWVRQAPGKGLEWVAVIAYDGRNKYYADSVKGRFTISRDNSKNTLYLEMNSLRPEDTAVYYCAKVGASGDYYYSYGLDVWGQGTTVTVSS

SEQ ID NO: 199 - protein, 110 aa, Artificial Sequence
  VL of affinity matured human IL-17 antibody G9 (#56)
QSVLTQPPSASGTPGQTVSISCSGNHSNIGNHFVDWYQQVPGAAPKLLMYYSWYRPSGVPDRFSGSQSGTSASLAISGLQSEDEADYYCATWDDSLGGYVFGSGTKVTVL

SEQ ID NO: 200 - protein, 124 aa, Artificial Sequence
  VH of affinity matured human IL-17 antibody G9 (#57)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKLGASGDYYYSYGLDVWGQGTTVTVSS

SEQ ID NO: 201 - protein, 110 aa, Artificial Sequence
  VL of affinity matured human IL-17 antibody G9 (#57)
QSVLTQPPSASGTPGQTVSISCSGSHSNIGRHYVDWYQQVPGAAPKLLMYYTGERPSGVPDRFSGSQSGTSASLAISGLQSEDEADYYCATWDDSLGGYVFGTGTKVTVL

SEQ ID NO: 202 - protein, 124 aa, Artificial Sequence
  VH of affinity matured human IL-17 antibody G9 (#58)
EVQLLESGGGVVQPGRSLRLSCAASGFIFSNYGMHWVRQAPGKGLEWVAVISSDGSNKYYADSVKGRFTISRDNSKNTLYLEMNSLRPEDTAVYYCAKLGASGPYYYTYGLDVWGQGTTVTVSS

SEQ ID NO: 203 - protein, 110 aa, Artificial Sequence
  VL of affinity matured human IL-17 antibody G9 (#58)
QSVLTQPPSASGTPGQTVSISCSGSNSNIGRHTVDWYQQVPGAAPKLLMYYTGMRPSGVPDRFSGSQSGTSASLAISGLQSEDEADYYCATWDDKLGGYDFGSGTKVTVL

SEQ ID NO: 204 - protein, 124 aa, Artificial Sequence
  VH of affinity matured human IL-17 antibody G9 (#59)
EVQLLESGGGVVQPGRSLRLSCAASGFIFSDYGMHWVRQAPGKGLEWVAVISYDGSRKYYEDSVKGRFTISRDNSKNTLYLEMNSLRPEDTAVYYCAKVGASGDYYYSYGLDVWGQGTTVTVSS

SEQ ID NO: 205 - protein, 110 aa, Artificial Sequence
  VL of affinity matured human IL-17 antibody G9 (#59)
QSVLTQPPSASGTPGQTVSISCSGTKSNIGRHYVDWYQQVPGAAPKLLMYWSGERPSGVPDRFSGSQSGTSASLAISGLQSEDEADYYCATWDDSLGGYVFGTGTKVTVL

SEQ ID NO: 206 - protein, 124 aa, Artificial Sequence
  VH of affinity matured human IL-17 antibody G9 (#60)
EVQLLESGGGVVQPGRSLRLSCAASGFIFSDYGMHWVRQAPGKGLEWVAVIAFDGSRKYYADSVKGRFTISRDNSKNTLYLEMNSLRPEDTAVYYCAKVGASGDYYYSYGLDVWGQGTTVTVSS

SEQ ID NO: 207 - protein, 110 aa, Artificial Sequence
  VL of affinity matured human IL-17 antibody G9 (#60)
QSVLTQPPSASGTPGQTVSISCSGRPSNIGRHSVDWYQQVPGAAPKLLMYYFGERPSGVPDRFSGSQSGTSASLAISGLQSEDEADYYCATWDDSLGGYVFGTGTKVTVL

SEQ ID NO: 208 - protein, 124 aa, Artificial Sequence; identical to SEQ ID NO: 40
  VH of affinity matured human IL-17 antibody G9 (#61)

SEQ ID NO: 209 - protein, 110 aa, Artificial Sequence
  VL of affinity matured human IL-17 antibody G9 (#61)
QSVLTQPPSASGTPGQTVSISCSGYDSNIGRHSVDWYQQVPGAAPKLLMYYYGYRPSGVPDRFSGSQSGTSASLAISGLQSEDEADYYCATWDDLLGGYVFGTGTKVTVL

SEQ ID NO: 210 - protein, 124 aa, Artificial Sequence; identical to SEQ ID NO: 40
  VH of affinity matured human IL-17 antibody G9 (#62)

SEQ ID NO: 211 - protein, 110 aa, Artificial Sequence
  VL of affinity matured human IL-17 antibody G9 (#62)
QSVLTQPPSASGTPGQTVSISCSGTISNIGRHSVDWYQQVPGAAPKLLMYYNGHRPSGVPDRFSGSQSGTSASLAISGLQSEDEADYYCATWDDSLGGYVFGTGTKVTVL

SEQ ID NO: 212 - protein, 123 aa, Artificial Sequence
  VH of affinity matured human IL-17 antibody G9 (#63)
EVQLLESGGGVVQPGRSLRLSCAASGFIFSNYGMHWVRQAPGKGLEWVAVISRDGSHKYYADSVKGRFTISRGNSKNTLYLEMNSLRPEDTAVYYCAKVGASGDYYYSYGLDVWGQGTTVTVS

SEQ ID NO: 213 - protein, 110 aa, Artificial Sequence
  VL of affinity matured human IL-17 antibody G9 (#63)
QSVLTQPPSASGTPGQTVSISCSGRYSNIGRHAVDWYQQVPGAAPKLLMYYIGHRPSGVPDRFSGSQSGTSASLAISGLQSEDEADYYCATWDDSLGGYVFGSGTKVTVL

SEQ ID NO: 214 - protein, 124 aa, Artificial Sequence
  VH of affinity matured human IL-17 antibody G9 (#64)
EVQLLESGGGVVQPGRSLRLSCAASGFIFSNYGMHWVRQAPGKGLEWVAVISNDGHGKYYADSVKGRFTISRDNSKNTLYLEMNSLRPEDTAVYYCAKVGASGDYYYSYGLDVWGQGTTVTVSS

SEQ ID NO: 215 - protein, 110 aa, Artificial Sequence
  VL of affinity matured human IL-17 antibody G9 (#64)
QSVLTQPPSASGTPGQTVSISCSGSNSNIGRHAVDWYQQVPGAAPKLLMYYIGERPSGVPDRFSGSQSGTSASLAISGLQSEDEADYYCATWDDSLGGYVFGSGTKVTVL

SEQ ID NO: 216 - protein, 124 aa, Artificial Sequence
  VH of affinity matured human IL-17 antibody G9 (#65)
EVQLLESGGGVVQPGRSLRLSCAASGFIFSNNGMHWVRQAPGKGLEWVAVISYDGSKKYYADSVKGRFTISRDNSKNTLYLEMNSLRPEDTAVYYCAKVGASGDYYYSYGLDFWGQGTTVTVSS

SEQ ID NO: 217 - protein, 110 aa, Artificial Sequence
  VL of affinity matured human IL-17 antibody G9 (#65)
QSVLTQPPSASGTPGQTVSISCSGTTSNIGRHAVDWYQQVPGAAPKLLMYYNGWRPSGVPDRFSGSQSGTSASLAISGLQSEDEADYYCATWDDSLGGYVFGSGTKVTVL

SEQ ID NO: 218 - protein, 124 aa, Artificial Sequence
  VH of affinity matured human IL-17 antibody G9 (#66)
EVQLLESGGGVVQPGRSLRLSCAASGFIFSNYGMHWVRQAPGKGLEWVAVISFDGSRKYYVDSVKGRFTISRDNSKNTLYLEMNSLRPEDTAVYYCAKLGASGDYYYSYGLDVWGQGTTVTVSS

SEQ ID NO: 219 - protein, 110 aa, Artificial Sequence
  VL of affinity matured human IL-17 antibody G9 (#66)
QSVLTQPPSASGTPGQTVSISCSGKNSNIGNHYVHWYQQVPGAAPKLLMYDFGQRPSGVPDRFSVSQSGTSASLAISGLQSEDEADYYCATWDDSLGGYVFGTGTKVTVL

SEQ ID NO: 220 - protein, 124 aa, Artificial Sequence
  VH of affinity matured human IL-17 antibody G9 (#67)
EVQLLESGGGVVQPGRSLRLSCAASGFIFSNYGMHWVRQAPGKGLEWVAVISSDGSKNYYVDSVKGRFTISRDNSKNTLYLEMNSLRPEDTAVYYCAKVGASGDYYYSYGLDVWGQGTTVTVSS

SEQ ID NO: 221 - protein, 110 aa, Artificial Sequence
  VL of affinity matured human IL-17 antibody G9 (#67)
QSVLTQPPSASGTPGQTVSISCSGTNSNIGNHFVHWYQQVPGAAPKLLMYDFSQRPSGVPDRFSGSQSGTSASLAISGLQSEDEADYYCATWDDWLVGYVFGTGTKVTVL

SEQ ID NO: 222 - protein, 124 aa, Artificial Sequence
  VH of affinity matured human IL-17 antibody G9 (#68)
EVQLLESGGGVVQPGRSLRLSCAASGFIFSNYGMHWVRQAQGKGLEWVAVISYDGSREYYGDSVKGRFTISRDNSKNTLYLEMNSLRPEDTAVYYCAKVGASGDYYYSYGLDVWGQGTTVTVSS

SEQ ID NO: 223 - protein, 110 aa, Artificial Sequence
  VL of affinity matured human IL-17 antibody G9 (#68)
QSMLTQPPSASGTPGQTVSISCSGRHSNIGSHEVHWYQQVPGAAPKLLMYDFGQRPSGVPDRFSGSQSGTSASLAISGLQSEDEADYYCATWDDWLGGYVFGTGTKVTVL

SEQ ID NO: 224 - protein, 124 aa, Artificial Sequence
  VH of affinity matured human IL-17 antibody G9 (#69)
EVQLLESGGGVVQPGRSLRLSCAASGFIFSDYGMHWVRQAPGKGLEWVAVISYDGCNQYYPDSVKGRFTISRDNSKNTLYLEMNSLRPEDTAVYYCAKVGASGDYYYSYGLDVWGQGTTVTVSS

SEQ ID NO: 225 - protein, 110 aa, Artificial Sequence
  VL of affinity matured human IL-17 antibody G9 (#69)
QSGLTQPPSASGTPGQTVSISCSGRTSNIGNHSVHWYQQVPGAAPKLLMYGFGVRPSGVPDRFSGSQSGTSASLAISGLQSEDEADYYCATWDDWLGSYVFGTGTKVTVL

SEQ ID NO: 226 - protein, 124 aa, Artificial Sequence
  VH of affinity matured human IL-17 antibody G9 (#70)
EVQLLESGGGVVQPGRSLRLSCAASGFIFSNYGMHWVRQAPGKGLEWVAVISNDGSNKYYTDSVKGRFTISRDNSKNTLYLEMNSLRPEDTAVYYCAKVGASGDYYYSYGLDVWGQGTTVTVSS

SEQ ID NO: 227 - protein, 110 aa, Artificial Sequence
  VL of affinity matured human IL-17 antibody G9 (#70)
QSVLTQPPSASGTPGQTVSISCSGKNSNIGRHSVHWYQQVPGAAPKLLMYWFGTRPSGVPDRFSGSQSGTSASLAISGLQSEDEADYYCATWDDRLGGYVFGTGTKVTVL

SEQ ID NO: 228 - protein, 124 aa, Artificial Sequence
  VH of affinity matured human IL-17 antibody G9 (#71)
EVQLLESGGGVVQPGRSLRLSCAASGFIFSNYGMHWVRQAPGKGLEWVAVISNDGSNKYYLDSVKGRFTISRDNSKNTLYLEMNSLRPEDTAVYYCAKVGASGDYYYSYGLDVWGQGTTVTVSS

SEQ ID NO: 229 - protein, 110 aa, Artificial Sequence
  VL of affinity matured human IL-17 antibody G9 (#71)
QSVLTQPPSASGTPGQTVSISCSGRNSNIGYHPVHWYQQVPGAAPKLLIYDFGLRPSGVPDRFSGSQSGTSASLSISGLQSEDEADYYCATWDDWLGGYVFGTGTKVTVL

SEQ ID NO: 230 - protein, 124 aa, Artificial Sequence
  VH of affinity matured human IL-17 antibody G9 (#72)
EVQLLESGGGVVQPGRSLRLSCAASGFIFTNYGMHWVRQAPGKGLEWVAVISHDGCNNYYADSVKGRFTISRDNSKNTLYLEMNSLRPEDTAVYYCAKVGASGAYYYSYGLDVWGQGTTVTVSS

SEQ ID NO: 231 - protein, 110 aa, Artificial Sequence
  VL of affinity matured human IL-17 antibody G9 (#72)
QSVLTQPPSASGTPGQTVSISCSGRNSNIGRHAVDWYQQVPGAAPKLLMYGIGQRPSGVPDRFSVSQSGTSASLAISGLQSEDEADYYCATWDDWLGGYVFGTGTKVTVL

SEQ ID NO: 232 - protein, 124 aa, Artificial Sequence
  VH of affinity matured human IL-17 antibody G9 (#73)
EVQLLESGGGVVQPGRSLRLSCAASGFIFSNYGMHWVRQAPGKGLEWVAVISYDGSNKYYGDSVKGRFTISRDNSKNTLYLEMNSLRPEDTAVYYCAKVGASGDYYYSYGLDVWGQGTTVTVSS

SEQ ID NO: 233 - protein, 110 aa, Artificial Sequence
  VL of affinity matured human IL-17 antibody G9 (#73)
QSVLTQPPSASGTPGQTVSISCSGTNSNIGSHAVDWYQQVPGAAPKLLMYGIDQRPSGVPDRFSVSQSGTSASLAISGLQSEDEADYYCATWDDWLAGYVFGTGTKVTVL

SEQ ID NO: 234 - protein, 124 aa, Artificial Sequence
  VH of affinity matured human IL-17 antibody G9 (#74)
EVQLLESGGGVVQPGRSLRLSCAASGFIFSNYGMHWVRQAPGKGLEWVAVISYDGTNKYYSDSVKGRFTISRDNSKNTLYLEMNSLRPEDTAVYYCAKVGASGDYYYSYGLDVWGQGTTVTVSS

SEQ ID NO: 235 - protein, 110 aa, Artificial Sequence
  VL of affinity matured human IL-17 antibody G9 (#74)
QSVLTQPPSASGTPGQTVSISCSGRNSNIGSHSVHWYQQVPGAAPKLLMYGIGERPSGVPDRFSVSQSGTSASLAISGLQSEDEADYYCATWDDWLAGYVFGTGTKVTVL

SEQ ID NO: 236 - protein, 124 aa, Artificial Sequence; identical to SEQ ID NO: 40
  VH of affinity matured human IL-17 antibody G9 (#75)

SEQ ID NO: 237 - protein, 110 aa, Artificial Sequence
  VL of affinity matured human IL-17 antibody G9 (#75)
QSVLTQPPSASGTPGQTVSISCSGRNSNIGSHYVHWYQQVPGAAPKLLMYDFGLRPSGVPDRFSVSQSGTSASLAISGLQSEDEADYYCATWDDMLGGYVFGTGTKVTVL

SEQ ID NO: 238 - protein, 124 aa, Artificial Sequence; identical to SEQ ID NO: 40
  VH of affinity matured human IL-17 antibody G9 (#76)

SEQ ID NO: 239 - protein, 110 aa, Artificial Sequence
  VL of affinity matured human IL-17 antibody G9 (#76)
QSVLTQPPTASGTPGQTVSISCSGRNSNIGNHSVHWYQQVPGAAPKLLMYDIGFRPSGVPDRFSVSQSGTSASLAISGLQSEDEADYYCATWDDWLGGYVFGTGTKVTVL

SEQ ID NO: 240 - protein, 124 aa, Artificial Sequence
  VH of affinity matured human IL-17 antibody G9 (#77)
EVQLLESGGGVVQPGRSLRLSCAASGFIFSNYGMHWVRQAPGKGLEWVAVISYDGSNKYYSDSVKGRFTISRDNSKNTLYLEMNSLRPEDTAVYYCAKVGASGDYYYSYGLDVWGQGTTVTVSS

SEQ ID NO: 241 - protein, 110 aa, Artificial Sequence
  VL of affinity matured human IL-17 antibody G9 (#77)
QSVLTQPPSASGTPGQTVSISCSGSHSNIGRHPVDWYQQVPGAAPKLLMYDFGQRPSGVPDRFSVSQSGTSASLAISGLQSEDEADYYCATWDDSLGGYVFGTGTKVTVL

SEQ ID NO: 242 - protein, 124 aa, Artificial Sequence
  VH of affinity matured human IL-17 antibody G9 (#78)
EVQLLESGGGVVQPGRSLRLSCAASGFIFSNYGMHWVRQAPGKGLEWVAVISCDGSNKYYADSVKGRFTISRDNSKNTLYLEMNSLRPEDTAVYYCAKVGASGDYYYSYGLDVWGQGTTVTVSS

SEQ ID NO: 243 - protein, 110 aa, Artificial Sequence
  VL of affinity matured human IL-17 antibody G9 (#78)
QSVLTQPPSASGTPGQTVSISCSGTNSNIGSHSVHWYQQVPGAAPKLLMYWFGERPSGVPDRFSGSPSGTSASLAISGLQSEDEADYYCATWDDSLGGYVFGSGTKVTVL

SEQ ID NO: 244 - protein, 124 aa, Artificial Sequence
  VH of affinity matured human IL-17 antibody G9 (#79)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGGSGEYYYSPGLDVWGQGTTVTVSS

SEQ ID NO: 245 - protein, 110 aa, Artificial Sequence
  VL of affinity matured human IL-17 antibody G9 (#79)
QSVLTQPPSASGTPGQTVSISCSGSNSNIGSRSVTWYQQVPGAAPKLLMYWFGHRPSGVPDRFSGSQSGTSASLAISGLQSEDEADYYCATWDDSLAEYVFGTGTKVTVL

SEQ ID NO: 246 - protein, 124 aa, Artificial Sequence
  VH of affinity matured human IL-17 antibody G9 (#80)
EVQLLESGGGVVQPGRSLRLSCAASGFIFSNYGMHWVRQAPGKGLEWVAVISYDGSKQYYADSVKGRFTISRDNSKNTLYLEMNSLRPEDTAVYYCAKVGASGDYYYSYGLDVWGQGTTVTVSS

SEQ ID NO: 247 - protein, 110 aa, Artificial Sequence
  VL of affinity matured human IL-17 antibody G9 (#80)
QSVLTQPPSASGTPGQTVSISCSGSNSNIGYHSVHWYQQVPGAAPKLLMYYFGNRPSGVPDRFSGSQSGTSASLAISGLQSEDEADYYCATWDDSLGGYVFGTGTKVTVL

SEQ ID NO: 248 - protein, 124 aa, Artificial Sequence
  VH of affinity matured human IL-17 antibody G9 (#81)
EVQLLESGGGVVQPGRSLRLSCAASGFIFRNYGMHWVRQAPGKGLEWVAVISYDGSNTYYADSVKGRFTISRDNSKNTLYLEMNSLRPEDTAVYYCAKVGAYGDYYYSYGLDVWGQGTTVTVSS

SEQ ID NO: 249 - protein, 110 aa, Artificial Sequence
  VL of affinity matured human IL-17 antibody G9 (#81)
QSVLTQPPSASGTPGQTVSISCSGTNSNIGSHSVHWYQQVPGAAPKLLIYDFGDRPSGVPDRFSGSQSGTSASLAISGLQSEDEADYYCATWDDRLGGYVFGTGTKVTVL

SEQ ID NO: 250 - protein, 124 aa, Artificial Sequence
  VH of affinity matured human IL-17 antibody G9 (#82)
EVQLLESGGGVVQPGRSLRLSCAASGFIFRNYGMHWVRQAPGKGLEWVAVISYDGRRNYYADSVKGRFTISRDNSKNTLYLEMNSLRPEDTAVYYCAKLGAYGPYYYSYGLDVWGQGTMVTVSS

SEQ ID NO: 251 - protein, 110 aa, Artificial Sequence
  VL of affinity matured human IL-17 antibody G9 (#82)
QSVLTQPPSASGTPGQTVSISCSGGNSNIGCHSVHWYQQVPGAAPKLLMYGMGYRPSGVPDRFSGSQSGTSASLAISGLQSEDEADYYCATWDDSLGGYVFGSGTKVTVL

SEQ ID NO: 252 - protein, 124 aa, Artificial Sequence
  VH of affinity matured human IL-17 antibody G9 (#83)
EVQLLESGGGVVQPGRSLRLSCAASGFIFSNYGMHWVRQAPGKGLEWVAVISYDGGNTYYADSVKGRFTISRDNSKNTLYLEMNSLRPEDTAVYYCAKVGANGDYYYSYGLDVWGQGTTVTVSS

SEQ ID NO: 253 - protein, 110 aa, Artificial Sequence
  VL of affinity matured human IL-17 antibody G9 (#83)
QSVLTQPPSASGTPGQTVSISCSGTNSNIGNHAVNWYQQVPGAAPKLLMYGLGMRPSGVPDRFSDSQSGTSASLAISGLQSEDEADYYCATWDDSLGGYVFGTGTKVTVL

SEQ ID NO: 254 - protein, 124 aa, Artificial Sequence; identical to SEQ ID NO: 148
  VH of affinity matured human IL-17 antibody G9 (#84)

SEQ ID NO: 255 - protein, 110 aa, Artificial Sequence
  VL of affinity matured human IL-17 antibody G9 (#84)
QSVLTQPPSASGTPGQTVSISCSGHNSNIGSHTVNWYQQVPGAAPKLLMYEIGYRPSGVPDRFSVSQSGTSASLAISGLQSEDEADYYCATWDDWLADYVFGSGTKVTVL

SEQ ID NO: 256 - protein, 124 aa, Artificial Sequence
  VH of affinity matured human IL-17 antibody G9 (#85)
EVQLLESGGGVVQPGRSLRLSCAASGFIFRNYGMHWVRQAPGKGLEWVAVIAYDGSRKYYADSVKGRFTISRDNSKNTLYLEMNSLRPEDTAVYYCAKVGASGDYYYSYGLDVWGQGTTVTVSS

SEQ ID NO: 257 - protein, 110 aa, Artificial Sequence
  VL of affinity matured human IL-17 antibody G9 (#85)
QSVLTQPPSASGTPGQTVSISCSGSNSNIGSHDVTWYQQVPGAAPKLLMYDMWERPSGVPDRFSVSQSGTSASLAISGLQSEDEADYYCATWDDWLGGYVFGSGTKVTVL

SEQ ID NO: 258 - protein, 124 aa, Artificial Sequence
  VH of affinity matured human IL-17 antibody G9 (#86)
EVQLLESGGGVVQPGRSLRLSCAASGFIFSNQGMHWVRQAPGKGLEWVAVIAYDGSKKYYADSVKGRFTISRDNSKNTLYLEMNSLRPEDTAVYYCAKVGASGDYYYSYGLDVWGQGTTVTVSS

SEQ ID NO: 259 - protein, 110 aa, Artificial Sequence
  VLof affinity matured human IL-17 antibody G9 (#86)
QSVLTQPPSASGTPGQTVSISCSGSNSNIGSHFVHWYQQVPGAAPKLLMYEYGWRPSGVPDRFSGSQSGTSASLAISGLQSEDEADYYCAIWDDRLVGYVFGSGTKVTVL

SEQ ID NO: 260 - protein, 124 aa, Artificial Sequence
  VH of affinity matured human IL-17 antibody G9 (#87)
EVQLLESGGGVVQPGRSLRLSCAASGFIFSNYGMHWVRQAPGKGLEWVTVISYDGSNKYYADSVKGRFTISRDNSKNTLYLEMNSLRPEDTAVYYCAKVGAYGDYYYSYGLDGWGQGTTVTVSS

SEQ ID NO: 261 - protein, 110 aa, Artificial Sequence
  VL of affinity matured human IL-17 antibody G9 (#87)
QSVLTQPPSASGTPGQTVSISCSGRQSNIGSHYVHWYQQVPGAAPKLLMYGIGERPSGVPDRFSGSQSGTSASLAISGLQSEDEADYYCATWDDRLVGYVFGSGTKVTVL

SEQ ID NO: 262 - protein, 124 aa, Artificial Sequence
  VH of affinity matured human IL-17 antibody G9 (#88)
EVQLLESGGGVVQPGRSLRLSCAASGFIFSNFGMHWVRQAPGKGLEWVAVISYDGSRKYYADSVKGRFTISRDNSKNTLYLEMNSLRPEDTAVYYCAKVGAYGDYYYSYGLDVWGQGTTVTVSS

SEQ ID NO: 263 - protein, 110 aa, Artificial Sequence
  VL of affinity matured human IL-17 antibody G9 (#88)
QSVLTQPPSASGTPGQTVSISCSGSNSNIGVHSVHWYQQVPGAAPKLLMYGIGQRPSGVPDRFSGSQSGTSASLAISGLQSEDEADYYCATWDDRLAGYVFGTGTKVTVL

SEQ ID NO: 264 - protein, 124 aa, Artificial Sequence
  VH of affinity matured human IL-17 antibody G9 (#89)
EVQLLESGGGVVQPGRSLRLSCAASGFIFSNYGMHWVRQAPGKGLEWVAVISYDGRNKYYADSVKGRFTISRDNSKNTLYLEMNSLRPEDTAVYYCAKVGASGDYYYSYGLDEWGQGTTVTVSS

SEQ ID NO: 265 - protein, 110 aa, Artificial Sequence
  VL of affinity matured human IL-17 antibody G9 (#89)
QSVLTQPPSASGTPGQTVSISCSGRNSNIGNHYVHWYQQVPGAAPKLLMYSIGLRPSGVPDRFSGSQSGTSASLAISGLQSEDEADYYCATWDDRLAGYVFGTGTKVTVL

SEQ ID NO: 266 - protein, 124 aa, Artificial Sequence
  VH of affinity matured human IL-17 antibody G9 (#90)
EVQLLESGGGVVQPGRSLRLSCAASGFIFSNYGMHWVRQAPGKGLEWVAVIAADGRKKYYADSVKGRFTISRDNSKNTLYLEMNSLRPEDTAVYYCAKVGAWGDYYYTYGLDSWGQGTTVTVSS

SEQ ID NO: 267 - protein, 110 aa, Artificial Sequence
  VL of affinity matured human IL-17 antibody G9 (#90)
QSVLTQPPSASGTPGQTVSISCSGRYSNIGNHSVHWYRQVPGAAPKLLMYGIDYRPSGVPDRFSGSQSGTSASLAISGLQSEDEADYYCATWDDWLGGYVFGTGTKVTVL

SEQ ID NO: 268 - protein, 124 aa, Artificial Sequence
  VH of affinity matured human IL-17 antibody G9 (#91)
EVQLLESGGGVVQPGRSLRLSCAASGFIFSNYGMHWVRQAPGKGLEWVAVIGYDGYRKYYADSVKGRFTISRDNSKNTLYLEMNSLRPEDTAVYYCAKVGASGDYYYSYGLDVWGQGTTVTVSS

SEQ ID NO: 269 - protein, 110 aa, Artificial Sequence
  VL of affinity matured human IL-17 antibody G9 (#91)
QSVLTQPPSASRTPGQTVPISCSGRHSNIGNHSVHWYQQVPGAAPKLLMYGIGERPSGVPDRFSGSQSGTSASLAISGLQSEDEADYYCATWDDWLAGYVFGTGTKVTVL

SEQ ID NO: 270 - protein, 124 aa, Artificial Sequence
  VH of affinity matured human IL-17 antibody G9 (#92)
EVQLLESGGGVVQPGRSLRLSCAASGFIFSNYGMHWVRQAPGKGLEWVAVIAYDGRKKYYADSVKGRFTISRDNSKNTLYLEMNSLRPEDTAVYYCAKVGASGDYYYSYGLDVWGQGTTVTVSS

SEQ ID NO: 271 - protein, 110 aa, Artificial Sequence
  VL of affinity matured human IL-17 antibody G9 (#92)
QSVLTQPPSASGTPGQTVSISCSGRNSNIGNHSVHWYQQVPGAAPKLLMYGTGHRPSGVPDRFSGSQSGTSASLAISGLQSEDEADYYCASWDDGLAGYVFGSGTKVTVL

SEQ ID NO: 272 - protein, 124 aa, Artificial Sequence; identical to SEQ ID NO: 40
  VH of affinity matured human IL-17 antibody G9 (#93)

SEQ ID NO: 273 - protein, 110 aa, Artificial Sequence
  VL of affinity matured human IL-17 antibody G9 (#93)
QSVLTQPPSASGTPGQTVSISCSGRKSNIGSHSVHWYQQVPGAAPKLLMYGYGERPSGVPDRFSGSQSGTSASLAISGLQSEDEADYYCAMWDDWLGGYVFGTGTKVTVL

SEQ ID NO: 274 - protein, 124 aa, Artificial Sequence; identical to SEQ ID NO: 40
  VH of affinity matured human IL-17 antibody G9 (#94)

SEQ ID NO: 275 - protein, 110 aa, Artificial Sequence
  VL of affinity matured human IL-17 antibody G9 (#94)
QSVLTQPPSASGTPGQTVSISCSGSISNIGSHSVHWYQQVPGAAPKLLMYGLGYRPSGVPDRFSVSQSGTSASLAISGLQSEDEADYYCATWDDSLGGYVFGTGTKVTVL

SEQ ID NO: 276 - protein, 124 aa, Artificial Sequence
  VH of affinity matured human IL-17 antibody G9 (#95)
EVQLLESGGGVVQPGRSLRLSCAASGFIFNNNGMHWVRQAPGKGLEWVAVISKDGRNKYYGDSVKGRFTISRDNSKNTLYLEMNSLRPEDTAVYYCAKVGAYGDYYYSYGLDVWGQGTTVTVSS

SEQ ID NO: 277 - protein, 110 aa, Artificial Sequence
  VL of affinity matured human IL-17 antibody G9 (#95)
QSVLTQPPSASGTPGQTVSISCSGSKSNIGSHYVHWYQQVPGAAPKLLMYGICQRPSGVPDRFSGSQSGTSASLAISGLQSEDEADYYCATWDDSLGGYVFGTGTKVTVL

SEQ ID NO: 278 - protein, 124 aa, Artificial Sequence
  VH of affinity matured human IL-17 antibody G9 (#96)
EVQLLESGGGVVQPGRSLRLSCAASGFIFSNYGMHWVRQAPGKGLEWVAVISRDGRRKYYSDSVKGRFTISRDNSKNTLYLEMNSLRPEDTAVYYCAKVGALGDYYYSYGLDVWGQGTTVTVSS

SEQ ID NO: 279 - protein, 110 aa, Artificial Sequence
  VL of affinity matured human IL-17 antibody G9 (#96)
QSVLTQPPSASGTPGQTVSISCSGSNSNIGRHYVHWYQQVPGAAPKLLMYGIGQRPSGVPDRFSGSQSGTSASLAISGLQSEDEADYYCATWDDSLGGYVFGSGTKVTVL

SEQ ID NO: 280 - protein, 124 aa, Artificial Sequence
  VH of affinity matured human IL-17 antibody G9 (#97)
EVQLLESGGGVVQPGRSLRLSCAASGFIFSNYGMHWVRQAPGKGLEWVAVISNDGTNKYYTDSVKGRFTISRDNSKNTLYLEMNSLRPEDTAVYYCAKVGASGDYYYSYGLDVWGQGTTVTVSS

SEQ ID NO: 281 - protein, 110 aa, Artificial Sequence
  VL of affinity matured human IL-17 antibody G9 (#97)
QSVLTQPPSASGTPGQTVSISCSGSKSNIGRHFVHWYQQVPGAAPKLLMYANGQRPSGVPDRFSGSQSGTSASLAISGLQSEDEADYYCATWDDSLGGYVFGSGTKVTVL

SEQ ID NO: 282 - protein, 124 aa, Artificial Sequence
  VH of affinity matured human IL-17 antibody G9 (#98)
EVQLLESGGGVVQPGRSLRLSCAASGFIFRNNGMHWVRQAPGKGLEWVAVISYDGRNKYYEDSVKGRFTISRDNSKNTLYLEMNSLRPEDTAVYYCAKVGASGDYYYSFGLDVWGQGTTVTVSS

SEQ ID NO: 283 - protein, 110 aa, Artificial Sequence
  VL of affinity matured human IL-17 antibody G9 (#98)
QSVLTQPPSASGTPGQTVSISCSGSISNIGRHAVHWYQQVPGAAPKLLMYYFGERPSGVPDRFSGSQSGTSASLAISGLQSEDEADYYCATWDDSLGGYVFGSGTKVTVL

SEQ ID NO: 284 - protein, 124 aa, Artificial Sequence
  VH of affinity matured human IL-17 antibody G9 (#99)
EVQLLESGGGVVQPGRSLRLSCAASGFIFSNYGMHWVRQAPGKGLEWVAVISYDGSNKYYADSVKGRFTISRDNSKNTLYLEMNSLRPEHTAVYYCAKVGASGDYYYSYGLDVWGQGTTVTVSS

SEQ ID NO: 285 - protein, 110 aa, Artificial Sequence
  VL of affinity matured human IL-17 antibody G9 (#99)
QSVLTQPPSASGTPGQTVSISCSGRNSNIGRHHVHWYQQVPGAAPKLLMYGIGYRPSGIPDRFSGSQSGTSASLAISGLQSEDEADYYCATWDDSLGAYVFGSGTKVTVL

SEQ ID NO: 286 - protein, 124 aa, Artificial Sequence; identical to SEQ ID NO: 40
  VH of affinity matured human IL-17 antibody G9 (#100)

SEQ ID NO: 287 - protein, 110 aa, Artificial Sequence
  VL of affinity matured human IL-17 antibody G9 (#100)
QSVLTQPPSASGTPGQTVSISCSGNRSNIGHHSVHWYQQVPGAAPKLLMYGISERPSGVPDRFSGSQSGTSASLAISGLQSEDEADYYCATWDDSLGGYVFGSGTKVTVL

SEQ ID NO: 288 - protein, 124 aa, Artificial Sequence; identical to SEQ ID NO: 40
  VH of affinity matured human IL-17 antibody G9 (#101)

SEQ ID NO: 289 - protein, 110 aa, Artificial Sequence
  VL of affinity matured human IL-17 antibody G9 (#101)
QSVLTQPPSASGTPGQTVSISCSGITSNIGRHSVHWYQQVPGAAPKLLMYGICQRPSGVPDRFSGSQSGTSASLAISGLQSEDEADYYCATWDDSLGGYVFGSGTKVTVL

SEQ ID NO: 290 - protein, 124 aa, Artificial Sequence
  VH of affinity matured human IL-17 antibody G9 (#102)
EVQLLESGGGVVQPGRSLRLSCAASGFIFSNYGMHWVRQAPGKGLEWVAVISYDGANRYYSDSVKGRFTISRDNSKNTLYLEMNSLRPEDTAVYYCAKVGASGDYYYSYGLDVWGQGTTVTVSS

SEQ ID NO: 291 - protein, 110 aa, Artificial Sequence
  VL of affinity matured human IL-17 antibody G9 (#102)
QSVLTQPPSASGTPGQTVSISCSGRNSNIGRHSVHWYQQVPGAAPKLLMYWYGQRPSGVPDRFSGSQSGTSASLAISGLQSEDEADYYCATWDDSLGGYVFGSGTKVTVL

SEQ ID NO: 292 - protein, 124 aa, Artificial Sequence
  VH of affinity matured human IL-17 antibody G9 (#103)
EVQLLESGGGVVQPGRSLRLSCAASGFIFSNYGMHWVRQAPGKGLEWVAVISYDGSNTYYADSVKGRFTISRDNSKNTLYLEMNSLRPEDTAVYYCAKVGASGDYYYSYGLDVWGQGTTVTVSS

SEQ ID NO: 293 - protein, 110 aa, Artificial Sequence
  VLof affinity matured human IL-17 antibody G9 (#103)
QSVLTQPPSASGTPGQTVSISCSGYNSNIGRHYVHWYQQVPGAAPKLLMYSNGLRPSGVPDRFSGSQSGTSASLAISGLQSEDEADYYCATWDDSLGGYVFGSGTKVTVL

SEQ ID NO: 294 - protein, 124 aa, Artificial Sequence
  VH of affinity matured human IL-17 antibody G9 (#104)
EVQLLESGGGVVQPGRSLRLSCAASGFIFSNYGMHWVRQAPGKGLEWVAVISYDGSNKYYVDSVKGRFTISRDNSKNTLYLEMNSLRPEDTAVYYCAKVGASGDYYYSYGLDVWGHGTTVTVSS

SEQ ID NO: 295 - protein, 110 aa, Artificial Sequence
  VL of affinity matured human IL-17 antibody G9 (#104)
QSVLTQPPSASGTPGQTVSISCSGINSNIGRHYVNWYQQVPGAAPKLLIYADGWRPSGVPDRFSGSQSGTSASLAISGLQSEDEADYYCATWDDSLGAYVFGSGTKVTVL

SEQ ID NO: 296 - protein, 124 aa, Artificial Sequence
  VH of affinity matured human IL-17 antibody G9 (#105)
EVQLLESGGGVVQPGRSLRLSCAASGFIFSNYGMHWVRQAPGKGLEWVAVISYDGGNQYYVDSVKGRFTISRDNSKNTLYLEMNSLRPEDTAVYYCAKVGASGDYYYSYGLDVWGQGTTVTVSS

SEQ ID NO: 297 - protein, 110 aa, Artificial Sequence
  VL of affinity matured human IL-17 antibody G9 (#105)
QSVLTQPPSASGTPGQTVSISCSGSNSNIGRHYVHWYQQVPGAAPKLLMYFNGVRPSGVPDRFSGSQSGTSASLTISGLQSEDEADYYCATWDDWLADYVFGSGTKVTVL

SEQ ID NO: 298 - protein, 124 aa, Artificial Sequence
  VH of affinity matured human IL-17 antibody G9 (#106)
EVQLLESGGGVVQPGRSLRLSCAASGFIFSNYGMHWVRQAPGKGLEWVAVISYDGHNQYYQDSVKGRFTISRDNSKNTLYLEMNSLRPEDTAVYYCAKVGASGDYYYSYGLDVWGQGTTVTVSS

SEQ ID NO: 299 - protein, 110 aa, Artificial Sequence
  VL of affinity matured human IL-17 antibody G9 (#106)
QSVLTQPPSASGTPGQTVSISCSGANSNIGRHYVHWYQQVPGAAPKLLIYYDGMRPSGVPDRFSGSQSGTSASLAISGPQSEDEADYYCATWDDRLVGYVFGTGTKVTVL

SEQ ID NO: 300 - protein, 124 aa, Artificial Sequence
  VH of affinity matured human IL-17 antibody G9 (#107)
EVQLLESGGGVVQPGRSLRLSCAASGFIFRNYGMHWVRQAPGKGLEWVAVISHDGSNKYYADSVKGRFTISRDNSKNTLYLEMNSLRPEDTAVYYCAKVGASGDYYYSYGLDVWGQGTTVTVSS

SEQ ID NO: 301 - protein, 110 aa, Artificial Sequence
  VL of affinity matured human IL-17 antibody G9 (#107)
QSVLTQPPSASGTPGQTVSISCSGINSNIGYHYVHWYQQVPGAGPKLLIYGSGERPSGVPDRFSGSQSGTSASLAISGLQSEDEADYYCATWDDSLVGYVFGTGTKVTVL

SEQ ID NO: 302 - protein, 124 aa, Artificial Sequence; identical to SEQ ID NO: 40
  VH of affinity matured human IL-17 antibody G9 (#108)

SEQ ID NO: 303 - protein, 110 aa, Artificial Sequence
  VL of affinity matured human IL-17 antibody G9 (#108)
QSVLTQPPSASGTPGQTVSISCSGHNSNIGYHYVHWYQQVPGAAPKLLIYGDGWRPSGVPDRFSGSQSGTSASLAISGLQSEDEADYYCGTWDDWLGGYVFGTGTKVTVL

SEQ ID NO: 304 - protein, 124 aa, Artificial Sequence
  VH of affinity matured human IL-17 antibody G9 (#109)
EVQLLESGGGVVQPGRSLRLSCAASGFIFSNYGMHWVHQAPGKGLEWVAVISHDGSKQYYADSLKGRFTISRDNSKNTLYLEMNSLRPEDTAVYYCAKLGASGDYYYSYGLDYWGQGTTVTVSS

SEQ ID NO: 305 - protein, 110 aa, Artificial Sequence
  VL of affinity matured human IL-17 antibody G9 (#109)
QSVLTQPPSASGTPGQTVSISCSGHNSNIGYHYVHWYQQVPGAAPKLLIYGDGWRPSGVPDRFSGSQSGTSASLAISGLQSEDEADYYCATWDDSLGGYVFGSGTKVTVL

SEQ ID NO: 306 - protein, 124 aa, Artificial Sequence
  VH of affinity matured human IL-17 antibody G9 (#110)
EVQLLESGGGVVQPGRSLRLSCAASGFIFGNYGMHWVRQAPGKGLEWVAVISYDGSNKYYGDSVKGRFTISRDNSKNTLYLEMNSLRPEDTAVYYCAKVGAYGDYYYSYGLDVWGQGTTVTVSS

SEQ ID NO: 307 - protein, 110 aa, Artificial Sequence
  VL of affinity matured human IL-17 antibody G9 (#110)
QSVLTQPPSASGTPGQTVSISCSGRQSNIGRHSVDWYQQVPGAAPKLIIYGIGQRPSGVPDRFSGSQSGTSASLTISGLQSEDEADYYCATWDDSLGGYVFGTGTKVTVL

SEQ ID NO: 308 - protein, 123 aa, Artificial Sequence
  VH of affinity matured human IL-17 antibody G9 (#111)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGAYGDYYYSYGLDFWGQGTTVTVS

SEQ ID NO: 309 - protein, 110 aa, Artificial Sequence
  VL of affinity matured human IL-17 antibody G9 (#111)
QSVLTQPPSASGTPGQTVSISCSGSNSNIGRHYVHWYQQVPGAAPKLLIYGVGQRPSGVPDRFSGSQSGTSASLAISGLQSEDEADYYCATWDDSLGGYVFGSGTKVTVL

SEQ ID NO: 310 - protein, 124 aa, Artificial Sequence
  VH of affinity matured human IL-17 antibody G9 (#112)
EVQLLESGGGVVQPGSSLRLSCAASGFIFSNYGMHWVRQAPGKGLEWVAVISYDGSNKYYADSVKGRFTISRDNSKNSLYLEMNSLRPEDTAVYYCAKVGASGDYYYSYGLDVWGQGTTVTVSS

SEQ ID NO: 311 - protein, 110 aa, Artificial Sequence
  VL of affinity matured human IL-17 antibody G9 (#112)
QSVLTQPPSASGTPGQTASISCSGSNSNIGRHYVDWYQQVPGAAPKLLIYGGGQRPSGVPDRFSGSQSGTSASLAISGLQSEDEADYYCATWDDSLGGYVFGSGTKVTVL

SEQ ID NO: 312 - protein, 124 aa, Artificial Sequence
  VH of affinity matured human IL-17 antibody G9 (#113)
EVQLLESGGGVVQPGRSLRLSCAASGFIFTNYGMHWVRQAPGKGLEWVAVISHDGSNKYYADSVKGRFTIPRDNSKNTLYLEMNSLRPEDTAVYYCAKVGASGDYYYSYGLDVWGQGTTVTVSS

SEQ ID NO: 313 - protein, 110 aa, Artificial Sequence
  VL of affinity matured human IL-17 antibody G9 (#113)
QSVLTQPPSASGTPGQTVSISCSGRNSNIGRHSVHWYQQVPGAAPKLLIYDVGQRPSGVPDRFSGSQSGTSASLAISGLQSEDEADYYCATWDDWLAGYVFGSGTKVTVL

SEQ ID NO: 314 - protein, 124 aa, Artificial Sequence
  VH of affinity matured human IL-17 antibody G9 (#114)
EVQLLESGGGVVQPGRSLRLSCAASGFIFRNYGMHWVRQAPGKGLEWVAVISYDGSNKYYADSVKGRFTISRDNSKNTLYLEMNSLKPEDTAVYYCAKVGASGDYYYSYGLDVWGQGTTVTVSS

SEQ ID NO: 315 - protein, 110 aa, Artificial Sequence
  VL of affinity matured human IL-17 antibody G9 (#114)
QSVLTQPPSASGTPGQTVSISCSGSNSNIGRHSVHWYQQVPGAAPKLLIYGDGQRPSGVPDRFSGSQSGTSASLAISGLQSEDEADYYCATWDDRLGGYVFGSGTKVTVL

SEQ ID NO: 316 - protein, 124 aa, Artificial Sequence
  VH of affinity matured human IL-17 antibody G9 (#115)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGAFGDYYYSYGLDVWGQGTTVTVSS

SEQ ID NO: 317 - protein, 110 aa, Artificial Sequence
  VL of affinity matured human IL-17 antibody G9 (#115)
QSVLTQPPSASGTPGQTVSISCSGNKSNIGRHYVHWYQQVPGAAPKLLMYYDGQRPSGVPDRFSGSQSGTSASLAISGLQSEDEADYYCGTWDDRLGGYVFGTGTKVTVL

SEQ ID NO: 318 - protein, 124 aa, Artificial Sequence
  VH of affinity matured human IL-17 antibody G9 (#116)
EVQLLESGGGVVQPGRSLRLSCAASGFLFSNYGMHWVRQAPGKGLEWVAVISYDGSNKYYADSVKGRFTISRDNSKNTLYLEMNSLRPEDTAVYYCAKVGAFGDYYYSYGLDVWGQGTTVTVSS

SEQ ID NO: 319 - protein, 110 aa, Artificial Sequence
  VL of affinity matured human IL-17 antibody G9 (#116)
QSVLTQPPSASGTPGQTVSISCSGSNSNIGMHYVHWYQQVPGAAPKLLMYYSGLRPSGVPDRFSGSQSGTSASLAISGLQSEDEADYYCATWDDSLGGYVFGTGTKVTVL

SEQ ID NO: 320 - protein, 124 aa, Artificial Sequence
  VH of affinity matured human IL-17 antibody G9 (#117)
EVQLLESGGGVVQPGRSPRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 321 - protein, 110 aa, Artificial Sequence
  VL of affinity matured human IL-17 antibody G9 (#117)
QSVLTQPPSASGTPGQTVSISCSGSRSNIGRHYVHWYQQVPGAAPKLLMYDYFYRPSGVPDRFSGSQSGTSASLAISGLQSEDEADYYCATWDDSLGGYVFGTGTKVTVL

SEQ ID NO: 322 - protein, 124 aa, Artificial Sequence; identical to SEQ ID NO: 232
  VH of affinity matured human IL-17 antibody G9 (#118)

SEQ ID NO: 323 - protein, 110 aa, Artificial Sequence
  VL of affinity matured human IL-17 antibody G9 (#118)
QSVLTQPPSASGTPGQTVSISCSGSNSNIGNHYVHWYQQVPGAAPKLLIYDFGYRPSGVPDRFSVSQSGTSASLAISGLQSEDEADYYCATWDDSLGGYVFGSGTKVTVL

SEQ ID NO: 324 - protein, 124 aa, Artificial Sequence
  VH of affinity matured human IL-17 antibody G9 (#119)
EVQLLESGGGVVQPGRSLRLSCAASGFIFSNYGMHWVRQAPGKGLEWVAVISHDGWSKYYADSVKGRFTISRDNSKNTLYLEMNSLRPEDTAVYYCAKVGASGDYYYSYGLDAWGQGTTVTVSS

SEQ ID NO: 325 - protein, 110 aa, Artificial Sequence
  VL of affinity matured human IL-17 antibody G9 (#119)
QSVLTQPPSASGTPGQTVSISCSGNYSNIGTHYVHWYQQVPGAAPKLLIYDFGHRPSGVPDRFSVSQSGTSASLAISGLQSEDEADYYCATWDDRLAGYVFGSGTKVTVL

SEQ ID NO: 326 - protein, 124 aa, Artificial Sequence
  VH of affinity matured human IL-17 antibody G9 (#120)
EVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDLWGQGTTVTVSS

SEQ ID NO: 327 - protein, 110 aa, Artificial Sequence
  VL of affinity matured human IL-17 antibody G9 (#120)
QSVLTQPPSASGTPGQTVSISCSGSYSNIGSHYVHWYQQVPGAAPKLLMYDFGERPSGVPDRFSGSQSGTSASLAISGLQSEDEADYYCATWDDSLGGYVFGSGTKVTVL

SEQ ID NO: 328 - protein, 124 aa, Artificial Sequence
  VH of affinity matured human IL-17 antibody G9 (#121)
EVQLLESGGGVVQPGRSLRLSCAASGFIFSNYGMHWVRQAPGKGLEWVAVISYDGGNAYYADSVKGRFTISRDNSENTLYLEMNSLRPEDTAVYYCAKLGASGDYYYSYGLDVWGQGTTVTVSS

SEQ ID NO: 329 - protein, 110 aa, Artificial Sequence
  VL of affinity matured human IL-17 antibody G9 (#121)
QSVLTQPPSASGTPGQTVSISCSGSNSNIGSHYVHWYQQVPGAAPKLLIYWGGLRPSGVPDRFSGSQSGTSASLAISGLQSEDEADYYCALWDDRLGGYVFGTGTKVTVL

SEQ ID NO: 330 - protein, 124 aa, Artificial Sequence
  VH of affinity matured human IL-17 antibody G9 (#122)
EVQLLESGGGVVQPGRSLRLSCAASGFIFSNYGMHWVRQAPGKGLEWVAVISYDGGYKYYADSVKGRFTISRDNSKNTLYLEMNSLRPEDTAVYYCAKLSLSGDYYYSYGFDGWGQGTTVTVSS

SEQ ID NO: 331 - protein, 110 aa, Artificial Sequence
  VL of affinity matured human IL-17 antibody G9 (#122)
QSVLTQPPSASGTPGQTVSISCSGSKSNIGSHYVHWYQQVPGAAPKLLMYDFGQRPSGVPDRFSGSQSGTSASLAISGLQSEDEADYYCGTWDDWLGGYVFGTGTKVTVL

SEQ ID NO: 332 - protein, 124 aa, Artificial Sequence
  VH of affinity matured human IL-17 antibody G9 (#123)
EVQLLESGGGVVQPGRSLRLSCAASGFIFSNYGMHWVRQAPGKGLEWVAVISYDGRNKYYADSVKGRFTISRDNSKNTLYLEMNSLRPEDTAVYYCAKVGAKGDYYYSYGLDLWGQGTTVTVSS

SEQ ID NO: 333 - protein, 110 aa, Artificial Sequence
  VL of affinity matured human IL-17 antibody G9 (#123)
QSVLTQPPSASGTPGQTVSISCSGNRSNIGSHYVHWYQQVPGAAPKLLIYSMGQRPSGVPDRFSGSQSGTSASLAISGLQSEDEADYYCATWDDSLGGYVFGTGTKVTVL

SEQ ID NO: 334 - protein, 124 aa, Artificial Sequence; identical to SEQ ID NO: 40
  VH of affinity matured human IL-17 antibody G9 (#124)

SEQ ID NO: 335 - protein, 110 aa, Artificial Sequence
  VL of affinity matured human IL-17 antibody G9 (#124)
QSVLTQPPSASGTPGQTVSISCSGSHSNIGRHPVDWYQQVPGAAPKLLMYYGGYRPSGVPDRFSGSQSGTSASLAISGLQSEDEADYYCATWDDRLVGYVFGSGTKVTVL

SEQ ID NO: 336 - protein, 124 aa, Artificial Sequence; identical to SEQ ID NO: 114
  VH of affinity matured human IL-17 antibody G9 (#125)

SEQ ID NO: 337 - protein, 110 aa, Artificial Sequence; identical to SEQ ID NO: 139
  VL of affinity matured human IL-17 antibody G9 (#125)

SEQ ID NO: 338 - protein, 5 aa, Artificial Sequence
  CDR-H1 consensus sequence
  MISC_FEATURE (1)..(1): N, D, Y or H
  MISC_FEATURE (2)..(2): Y,N,H,Q, or F
  MISC_FEATURE (3)..(3)
XXGMH

SEQ ID NO: 339 - protein, 17 aa, Artificial Sequence
  CDR-H2 consensus sequence
  MISC_FEATURE (3)..(3): A, G, or S
  MISC_FEATURE (4)..(4): Y, N, S, H, R, F, C, M, K, or A
  MISC_FEATURE (7)..(7): S, R, T, G, W, H, C, Y, or A
  MISC_FEATURE (8)..(8): N, R, K, S, H, G, or Y
  MISC_FEATURE (9)..(9): K, Q, T, R, N, A, G, S, or E
  MISC_FEATURE (12)..(12): A, S, V, G, T, E, P, R, Q, or L
  MISC_FEATURE (15)..(15): V or L
VIXXDGXXXYYXDSXKG

SEQ ID NO: 340 - protein, 15 aa, Artificial Sequence
  CDR-H3 consensus sequence
  MISC_FEATURE (1)..(1): V or L
  MISC_FEATURE (2)..(2): G or S
  MISC_FEATURE (3)..(3): A, L, or G
  MISC_FEATURE (4)..(4): S, Y, L, F, W, N, or K
  MISC_FEATURE (6)..(6): D, P, N, E, or A
  MISC_FEATURE (10)..(10): S or T
  MISC_FEATURE (11)..(11): Y, P, or F
  MISC_FEATURE (13)..(13): L or F
  MISC_FEATURE (15)..(15): V, L, Y, G, F, A, S, or E
XXXXGXYYYXXGXDX

SEQ ID NO: 341 - protein, 13 aa, Artificial Sequence
  CDR-L1 consensus sequence
  MISC_FEATURE (3)..(3): R, S, T, N, H, I, Y, K, G, or A
  MISC_FEATURE (4)..(4): N, Q, K, H, R, Y, T, I, P, S, M, or D
  MISC_FEATURE (9)..(9): R, S, N, Y, T, C, V, M, H, or G
  MISC_FEATURE (10)..(10): H or R
  MISC_FEATURE (11)..(11): Y, S, P, A, F, T, H, E, D, or C
  MISC_FEATURE (13)..(13): D, H, N, T, or Y
SGXXSNIGXXXVX

SEQ ID NO: 342 - protein, 7 aa, Artificial Sequence
  CDR-L2 consensus sequence
  MISC_FEATURE (1)..(1): Y, G, D, W, F, S, E, or A
  MISC_FEATURE (2)..(2): D, I, F, T, S, N, G, Y, V, M, or L
  MISC_FEATURE (3)..(3): G, S, D, V, W, C, or F
  MISC_FEATURE (4)..(4): Q, I, Y, E, L, H, W, M, V, T, S, N, F, or D
XXXXRPS

SEQ ID NO: 343 - protein, 11 aa, Artificial Sequence
  CDR-L3 consensus sequence
  MISC_FEATURE (1)..(1): A or G
  MISC_FEATURE (2)..(2): T, S, M, L, or I
  MISC_FEATURE (6)..(6): S, W, R, M,  L, K, H, G, or F
  MISC_FEATURE (8)..(8): G, A, or V
  MISC_FEATURE (9)..(9): G, A, E, D, V, or S
  MISC_FEATURE (11)..(11): V or D
XXWDDXLXXYX

SEQ ID NO: 344 - protein, 124 aa, Artificial Sequence; identical to SEQ ID NO: 40
  VH of IL-17 antibody G9-1

SEQ ID NO: 345 - protein, 111 aa, Artificial Sequence
  VL of IL-17 antibody G9-1
QSVLTQPPSASGTPGQTVSISCSGSHSNIGRHPVDWYQQVPGAAPKLLMYYGGYRPSGVPDRFSGSQSGTSASLAISGLQSEDEADYYCATWDDRLVGYVFGSGTKVTVLG

SEQ ID NO: 346 - protein, 124 aa, Artificial Sequence; identical to SEQ ID NO: 40
  VH of IL-17 antibody G9-3

SEQ ID NO: 347 - protein, 111 aa, Artificial Sequence
  VL of IL-17 antibody G9-3
QSVLTQPPSASGTPGQTVSISCSGRNSNIGSHYVHWYQQVPGAAPKLLMYDFGLRPSGVPDRFSVSQSGTSASLAISGLQSEDEADYYCATWDDMLGGYVFGTGTKVTVLG

SEQ ID NO: 348 - protein, 111 aa, Artificial Sequence
  VL of IL-17 antibody G9-4
QSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVFGSGTKVTVLG

SEQ ID NO: 349 - protein, 124 aa, Artificial Sequence; identical to SEQ ID NO: 40
  VH of IL-17 antibody G9-M3

SEQ ID NO: 350 - protein, 111 aa, Artificial Sequence
  VL of IL-17 antibody G9-M2
QSVLTQPPSASGTPGQTVSISCSGHNSNIGYHYVHWYQQVPGAAPKLLIYGDGWRPSGVPDRFSGSQSGTSASLAISGLQSEDEADYYCGTWDDWLGGYVFGTGTKVTVLG

SEQ ID NO: 351 - protein, 124 aa, Artificial Sequence; identical to SEQ ID NO: 114
  VH of IL-17 antibody G9-2

SEQ ID NO: 352 - protein, 111 aa, Artificial Sequence
  VL of IL-17 antibody G9-2
QSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG

SEQ ID NO: 353 - protein, 124 aa, Artificial Sequence; identical to SEQ ID NO: 85
  VH of IL-17 antibody G9-5

SEQ ID NO: 354 - protein, 111 aa, Artificial Sequence
  VL of IL-17 antibody G9-5
QSVLTQPPSASGTPGQTVSISCSGRQSNIGRHYVDWYQQVPGAAPKLLMYYDSIRPSGVPDRFSGSQSGTSASLAISGLQSEDEADYYCGMWDDSLAGYVFGSGTKVTVLG

SEQ ID NO: 355 - protein, 124 aa, Artificial Sequence; identical to SEQ ID NO: 126
  VH of IL-17 antibody G9-6

SEQ ID NO: 356 - protein, 111 aa, Artificial Sequence
  VL of IL-17 antibody G9-6
QSVLTQPPSASGTPGQTVSISCSGRQSNIGNHYVDWYQQVPGAAPKLLIYGDVIRPSGVPDRFSGSQSGTSASLAISGLQSEDEADYYCATWDDWLAGYVFGSGTKVTVLG

SEQ ID NO: 357 - protein, 124 aa, Artificial Sequence; identical to SEQ ID NO: 330
  VH of IL-17 antibody G9-M1

SEQ ID NO: 358 - protein, 111 aa, Artificial Sequence
  VL of IL-17 antibody G9-M1
QSVLTQPPSASGTPGQTVSISCSGSKSNIGSHYVHWYQQVPGAAPKLLMYDFGQRPSGVPDRFSGSQSGTSASLAISGLQSEDEADYYCGTWDDWLGGYVFGTGTKVTVLG

SEQ ID NO: 359 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITTFFGITDYAQKFQGRVTITADESTTTAYMELSGLTSDDTAVYYCARDPNEFWNGYYATHDFDYWGQGTTVTVSS

SEQ ID NO: 360 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITNFFGWTDYAQKFQGRVTITADESTTTAYMELSGLTSDDTAVYYCARDPNEFWNGYYATHDFDYWGQGTTVTVSS

SEQ ID NO: 361 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITNFFGAVDYAQKFQGRVTITADESTTTAYMELSGLTSDDTAVYYCARDPNEFWNGYYATHDFDYWGQGTTVTVSS

SEQ ID NO: 362 - protein, 126 aa, Artificial Sequence
  VH of affinity matured fully human IL-17 antibody IL-17-TN-K7-B6
EVQLVQSGAEVKKPGESLKISCKASGGSFVSYGICWVRQAPGQGLEWMGGITNFFGTTDYAQKFQGRVTITADESTTTAYMELSGLTSDDTAVYYCARDPNEFWNGYYATHDFDYWGQGTTVTVSS

SEQ ID NO: 363 - protein, 126 aa, Artificial Sequence
  VH of affinity matured fully human IL-17 antibody IL-17-TN-K7-B6
EVQLVQSGAEVKKPGESLKISCKASGGSFSSYGIVWVRQAPGQGLEWMGGITTFFGATDYAQKFQGRVTITADESTTTAYMELSGLTSDDTAVYYCARDPNEFWNGYYATHDFDYWGQGTTVTVSS

SEQ ID NO: 364 - protein, 126 aa, Artificial Sequence
  VH of affinity matured fully human IL-17 antibody IL-17-TN-K7-B6
EVQLVQSGAEVKKPGESLKISCKASGGSFSSYGIVWVRQAPGQGLEWMGGITTFFGATDYAQKFQGRVTITADESTTTAYMELSGLTSDDTAVYYCARDPNEFWNGYYATHDFDIWGQGTTVTVSS

SEQ ID NO: 365 - protein, 126 aa, Artificial Sequence
  VH of affinity matured fully human IL-17 antibody IL-17-TN-K7-B6
EVQLVQSGAEVKKPGESLKISCKASGGSFSSYGIVWVRQAPGQGLEWMGGITTFFGATDYAQKFQGRVTITADESTTTAYMELSGLTSDDTAVYYCARDPNEFWNGYYDTHDFDSWGQGTTVTVSS

SEQ ID NO: 366 - protein, 126 aa, Artificial Sequence
  VH of affinity matured fully human IL-17 antibody IL-17-TN-K7-B6
EVQLVQSGAEVKKPGESLKVSCKASGGSFKSYGISWVRQAPGQGLEWMGGITIFFGTVDYAQKFQGRVTITADESTTTAYMELSGLTSDDTAVYYCARDPNEFWNGYYNTHDFDYWGQGTTVTVSS

SEQ ID NO: 367 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITHFFGTVDYAQKFQGRVTITADESTTTAYMELSGLTSDDTAVYYCARDPNEFWNGYYDTHDLDYWGQGTTVTVSS

SEQ ID NO: 368 - protein, 126 aa, Artificial Sequence
  VH of affinity matured fully human IL-17 antibody IL-17-TN-K7-B6
EVQLVQSGAEVKMPGSSLKISCKASGGSFRGYGISWVRQAPGQGLEWMGGITPFFGWADYAQKFQGRVTITADESTTTAYMELSGLTSDDTAVYYCARDPNEFWNGYYDTHHFDYWGQGTTVTVSS

SEQ ID NO: 369 - protein, 126 aa, Artificial Sequence
  VH of affinity matured fully human IL-17 antibody IL-17-TN-K7-B6
EVQLVQSGAEVKMPGSSLKISCKASGGSFRGYGISWVRQAPGQGLEWMGGITPFFGWADYAQKFQGRVTITADESTTTAYMELSGLTSDDTAVYYCARDPNEFWNGYYDTHDFDSWGQGTTVTVSS

SEQ ID NO: 370 - protein, 126 aa, Artificial Sequence
  VH of affinity matured fully human IL-17 antibody IL-17-TN-K7-B6
EVQLVQSGAEVKKPGESLKISCKASGGSFKGYGISWVRQAPGQGLEWMGGITPFFGWTDYAQKFQGRVTITADESTTTAYMELSGLTSDDTAVYYCARDPNEFWNGYYATHDFDYWGQGTTVTVSS

SEQ ID NO: 371 - protein, 126 aa, Artificial Sequence
  VH of affinity matured fully human IL-17 antibody IL-17-TN-K7-B6
EVQLVQSGAEVKKPGESLKISCKASGGSFKGYGISWVRQAPGQGLEWMGGITPFFGWTDYAQKFQGRVTITADESTTTAYMELSGLTSDDTAVYYCARDPNEFWNGYYDTHHFDYWGQGTTVTVSS

SEQ ID NO: 372 - protein, 126 aa, Artificial Sequence
  VH of affinity matured fully human IL-17 antibody IL-17-TN-K7-B6
EVQLVQSGAEVKKPGESLKVSCKASGGRFRTYGISWVRQAPGQGLEWMGGITNFFGWTDYAQKFQGRVTITADESTTTAYMELSGLTSDDTAVYYCARVPNEFWNGYYATDYFDNWGQGTTVTVSS

SEQ ID NO: 373 - protein, 126 aa, Artificial Sequence
  VH of affinity matured fully human IL-17 antibody IL-17-TN-K7-B6
EVQLVQSGAEVKKPGESLKVSCKASGGRFRTYGISWVRQAPGQGLEWMGGITNFFGWTDYAQKFQGRVTITADESTTTAYMELSGLTSDDTAVYYCAREPNEFWNGYYTTHDFDSWGQGTTVTVSS

SEQ ID NO: 374 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITHFFGSTDYAQKFQGRVTITADESTTTAYMELSGLTSDDTAVYYCARDPNEFWNGYYATHDFDYWGQGTTVTVSS

SEQ ID NO: 375 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITHFFGSTDYAQKFQGRVTITADESTTTAYMELSGLTSDDTAVYYCARVPNEFWNGYYATQDFDYWGQGTTVTVSS

SEQ ID NO: 376 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITHFFGSTDYAQKFQGRVTITADESTTTAYMELSGLTSDDTAVYYCARVPNEFWNGYYATDYFDYWGQGTTVTVSS

SEQ ID NO: 377 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITHFFGSTDYAQKFQGRVTITADESTTTAYMELSGLTSDDTAVYYCAREPNEFWNGYYTTHDFDSWGQGTTVTVSS

SEQ ID NO: 378 - protein, 126 aa, Artificial Sequence
  VH of affinity matured fully human IL-17 antibody IL-17-TN-K7-B6
EVQLVQSGAEVKKPGSSLKISCKASGGSFLSYGISWVRQAPGLGLEWMGGITLFFGTVDYAQKFQGRVTITADESTTTAYMELSGLTSDDTAVYYCAREPNEFWNGYYSTHDFDYWGQGTTVTVSS

SEQ ID NO: 379 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITLFFGTVDYAQKFQGRVTITADESTTTAYMELSGLTSDDTAVYYCAREPNEFWNGYYATHDFDYWGQGTTVTVSS

SEQ ID NO: 380 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITLFFGISDYAQKFQGRVTITADESTTTAYMELSGLTSDDTAVYYCAREPNEFWNGYYTTHDFDSWGQGTTVTVSS

SEQ ID NO: 381 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITNFFGAVDYAQKFQGRVTITADESTTTAYMELSGLTSDDTAVYYCAREPNEFWNGYYTTHDFDAWGQGTTVTVSS

SEQ ID NO: 382 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITNFFGMEDYAQKFQGRVTITADESTTTAYMELSGLTSDDTAVYYCAREPNEFWNGYYSTHDFDYWGQGTTVTVSS

SEQ ID NO: 383 - protein, 126 aa, Artificial Sequence
  VH of affinity matured fully human IL-17 antibody IL-17-TN-K7-B6
EVQLVQSGAEVKKPGESLKISCKASGGSFSGYGTSWVRQAPGQGLEWMGGITHFFGAVDYAQKFQGRVTITADESTTTAYMELSGLTSDDTAVYYCARDPNEFWNGYYATHDFDYWGQGTTVTVSS

SEQ ID NO: 384 - protein, 126 aa, Artificial Sequence
  VH of affinity matured fully human IL-17 antibody IL-17-TN-K7-B6
EVQLVQSGAEVKKPGESLKISCKASGGSFSGYGTSWVRQAPGQGLEWMGGITHFFGAVDYAQKFQGRVTITADESTTTAYMELSGLTSDDTAVYYCARDPHEFWNGYYATHDFDYWGQGTTVTVSS

SEQ ID NO: 385 - protein, 126 aa, Artificial Sequence
  VH of affinity matured fully human IL-17 antibody IL-17-TN-K7-B6
EVQLVQSGAEVKKPGESLKISCKASGGSFSGYGTSWVRQAPGQGLEWMGGITHFFGAVDYAQKFQGRVTITADESTTTAYMELSGLTSDDTAVYYCARDPNEFWNGYYDTHDFDSWGQGTTVTVSS

SEQ ID NO: 386 - protein, 126 aa, Artificial Sequence
  VH of affinity matured fully human IL-17 antibody IL-17-TN-K7-B6
EVQLVQSGAEVKKPGESVKVSCKASGGSFSGYGTSWVRQAPGQGLEWMGGITHFFGAVDYAQKFQGRVTITADESTTTAYMELSGLTSDDTAVYYCAREPNEFWNGYYSTHDFDYWGQGTTVTVSS

SEQ ID NO: 387 - protein, 126 aa, Artificial Sequence
  VH of affinity matured fully human IL-17 antibody IL-17-TN-K7-B6
EVQLVQSGAEVKKPGESVKVSCKASGGSFSGYGISWVRQAPGQGLEWMGGITNFFGIVDYAQKFQGRVTITADESTTTAYMELSGLTSDDTAVYYCARDPNEFWNGYYATHDFDYWGQGTTVTVSS

SEQ ID NO: 388 - protein, 126 aa, Artificial Sequence
  VH of affinity matured fully human IL-17 antibody IL-17-TN-K7-B6
EVQLVQSGAEVKKPGESVKVSCKASGGSFSGYGISWVRQAPGQGLEWMGGITNFFGIVDYAQKFQGRVTITADESTTTAYMELSGLTSDDTAVYYCAREPNEFWNGYYATHDFDYWGQGTTVTVSS

SEQ ID NO: 389 - protein, 126 aa, Artificial Sequence
  VH of affinity matured fully human IL-17 antibody IL-17-TN-K7-B6
EVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 390 - protein, 126 aa, Artificial Sequence
  VH of affinity matured fully human IL-17 antibody IL-17-TN-K7-B6
EVQLVQSGAEVKKPGSSVKVSCKASGGSFSSYGICWVRQAPGQGLEWMGGVTTFFGFADYAQKFQGRVTITADESTTTAYMELSGLTSDDTAVYYCARDPNEFWNGYYATHDFDYWGQGTTVTVSS

SEQ ID NO: 391 - protein, 126 aa, Artificial Sequence
  VH of affinity matured fully human IL-17 antibody IL-17-TN-K7-B6
EVQLVQSGAEVKKPGSSVKVSCKASGGSFTSYGISWVRQAPGQGLEWVGGITTFFGVADYAQKFQGRVTITADESTTTAYMELSGLTSDDTAVYYCARDPHEFWNGYYATHDFDYWGQGTTVTVSS

SEQ ID NO: 392 - protein, 126 aa, Artificial Sequence
  VH of affinity matured fully human IL-17 antibody IL-17-TN-K7-B6
EVQLVQSGAEVKKPGESVKVSCKASGGSFRGYGISWVRQAPGQGLEWMGGITHFFGMTDYAQKFQGRVTITADESTTTAYMELSGLTSDDTAVYYCARDPNEFWNGYYATHDFDYWGQGTTVTVSS

SEQ ID NO: 393 - protein, 126 aa, Artificial Sequence
  VH of affinity matured fully human IL-17 antibody IL-17-TN-K7-B6
EVQLVQSGAEVKKPGESVKVSCKASGGSFRSYGISWVRQAPGQGLEWMGGITTFFGTTDYAQKFQGRVTITADESTTTAYMELSGLTSDDTAVYYCARDPNEFWNGYYATHDFDYWGQGTTVTVSS

SEQ ID NO: 394 - protein, 126 aa, Artificial Sequence
  VH of affinity matured fully human IL-17 antibody IL-17-TN-K7-B6
EVQLVQSGAEVKKPGESVKVSCKASGGSFRSYGIGWVRQAPGQGLEWMGGITNFFGVEDYAQKFQGRVTITADESTTTAYMELSGLTSDDTAVYYCARDPNEFWNGYYATHDFDYWGQGTTVTVSS

SEQ ID NO: 395 - protein, 126 aa, Artificial Sequence
  VH of affinity matured fully human IL-17 antibody IL-17-TN-K7-B6
EVQLVQSGAEVKKPGESVKISCKASGGSFLSYGISWVRQAPGQGLEWMGGITHFFGISDYAQKFQGRVTITADESTTTAYMELSGLTSDDTAVYYCARDPNEFWNGYYATHDFDYWGQGTTVTVSS

SEQ ID NO: 396 - protein, 126 aa, Artificial Sequence
  VH of affinity matured fully human IL-17 antibody IL-17-TN-K7-B6
EVQLVQSGAEVKKPGESVKISCKASGGSFPSYGISWVRQAPGQGLEWMGGITNFFGIRDYAQKFQGRVTITADESTTTAYMELSGLTSDDTAVYYCAREPNEFWNGYYATHDFDYWGQGTTVTVSS

SEQ ID NO: 397 - protein, 126 aa, Artificial Sequence
  VH of affinity matured fully human IL-17 antibody
EVQLVQSGAEVKKPGESVKISCKASGGSFSSYGISWVRQAPGQGLEWMGGITVFFGTADYAQKFQGRVTITADESTTTAYMELSGLTSDDTAVYYCARVPNEFWNGYYATQDFDYWGQGTTVTVSS

SEQ ID NO: 398 - protein, 126 aa, Artificial Sequence
  VH of affinity matured fully human IL-17 antibody IL-17-TN-K7-B6
EVQLVQSGAEVKKPGSSVKISCKASGGSFSSYGISWVRQAPGQGLEWMGGITLFFGTTDYAQKFQGRVTITADESTTTAYMELSGLTSDDTAVYYCARDPNEFWNGYYDTHDFDSWGQGTTVTVSS

SEQ ID NO: 399 - protein, 126 aa, Artificial Sequence
  VH of affinity matured fully human IL-17 antibody IL-17-TN-K7-B6
EVQLVQSGAEVKKPGSSVKISCKASGGSFRSYGISWVRQAPGQGLEWMGGITHFFGMVDYAQKFQGRVTITADESTTTAYMELSGLTSDDTAVYYCAREPNEFWNGYYATHDFDYWGQGTTVTVSS

SEQ ID NO: 400 - protein, 126 aa, Artificial Sequence
  VH of affinity matured fully human IL-17 antibody IL-17-TN-K7-B6
EVQLVQSGAEVKKPGSSVKISCKASGGSFRSYGISWVRQAPGQGLEWMGGITHFFGMVDYAQKFQGRVTITADESTTTAYMELSGLTSDDTAVYYCAREPNEFWNGYYSTHDFDYWGQGTTVTVSS

SEQ ID NO: 401 - protein, 126 aa, Artificial Sequence
  VH of affinity matured fully human IL-17 antibody IL-17-TN-K7-B6
EVQLVQSGAEVKKPGSSVKISCKASGGSFTSYGISWVRQAPGQGLEWMGGITNFFGSTDYAQKFQGRVTITADESTTTAYMELSGLTSDDTAVYYCAREPNEFWNGYYSTHDFDYWGQGTTVTVSS

SEQ ID NO: 402 - protein, 126 aa, Artificial Sequence
  VH of affinity matured fully human IL-17 antibody IL-17-TN-K7-B6
EVQLVQSGAEVKKPGSSVKISCKASGGSFTSYGISWVRQAPGQGLEWMGGITNFFGSTDYAQKFQGRVTITADESTTTAYMELSGLTSDDTAVYYCAREPNEFWNGYFATNDFDYWGQGTTVTVSS

SEQ ID NO: 403 - protein, 126 aa, Artificial Sequence
  VH of affinity matured fully human IL-17 antibody IL-17-TN-K7-B6
EVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 404 - protein, 126 aa, Artificial Sequence
  VH of affinity matured fully human IL-17 antibody IL-17-TN-K7-B6
EVQLVQSGAEVKKPGESVKVSCKASGGSFISYGISWVRQAPGQGLEWMGGITHFFGTVDYAQKFQGRVTITADESTTTAYMELSGLTSDDTAVYYCAREPNEFWNGYYTTHDFDSWGQGTTVTVSS

SEQ ID NO: 405 - protein, 126 aa, Artificial Sequence
  VH of affinity matured fully human IL-17 antibody IL-17-TN-K7-B6
EVQLVQSGAEVKKPGESVKVSCKASGGSFISYGFSWVRQAPGQGLEWMGGITVFFGHVYYAQKFQGRVTITADESTTTAYMELSGLTSDDTAVYYCAREPNEFWNGYYSTHDFDYWGQGTTVTVSS

SEQ ID NO: 406 - protein, 126 aa, Artificial Sequence
  VH of affinity matured fully human IL-17 antibody IL-17-TN-K7-B6
EVQLVQSGAEVKKPGSSVKVSCKASGGSFISYGYNWVRQAPGQGLEWMGGITPFFGTADYAQKFQGRVTITADESTTTAYMELSGLTSDDTAVYYCARESSEFWNGYYCTQDFDLWGQGTTVTVSS

SEQ ID NO: 407 - protein, 126 aa, Artificial Sequence
  VH of affinity matured fully human IL-17 antibody IL-17-TN-K7-B6
EVQLVQSGAEVKKPGSSVKVSCKASGGSFLSYGFSWVRQAPGQGLEWMGGITPFFGLADYAQKFQGRVTITADESTTTAYMELSGLTSDDTAVYYCARESSEFWNGYYCTQDFDLWGQGTTVTVSS

SEQ ID NO: 408 - protein, 126 aa, Artificial Sequence
  VH of affinity matured fully human IL-17 antibody IL-17-TN-K7-B6
EVQLVQSGAEVKKPGESLKISCKASGGSFTTYGMNWVRQAPGQGLEWMGGITPFFGWADYAQKFQGRVTITADESTTTAYMELSGLTSDDTAVYYCARESSEFWNGYYCTQDFDLWGQGTTVTVSS

SEQ ID NO: 409 - protein, 126 aa, Artificial Sequence
  VH of affinity matured fully human IL-17 antibody IL-17-TN-K7-B6
EVQLVQSGAEVKKPGESLKISCKASGGSFSSYGFGWVRQAPGQGLEWMGGITPFFGIADYAQKFQGRVTITADESTTTAYMELSGLTSDDTAVYYCARESSEFWNGYYVTNDFDYWGQGTTVTVSS

SEQ ID NO: 410 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESNEFWNGYYPTLDLDSWGQGTTVTVSS

SEQ ID NO: 411 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESNEFWNGYYPTQDYDFWGQGTTVTVSS

SEQ ID NO: 412 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESSAFWNGYYNTNDLDYWGQGTTVTVSS

SEQ ID NO: 413 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESTEFWNGYYNTNDYDNWGQGTTVTVSS

SEQ ID NO: 414 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDFDYWGQGTTVTVSS

SEQ ID NO: 415 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDLDYWGQGTTVTVSS

SEQ ID NO: 416 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARESNDFWNGYYTTDDFDCWGQGTTVTVSS

SEQ ID NO: 417 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARVPNEFWNGYFPTQDFDYWGQGTTVTVSS

SEQ ID NO: 418 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARETNEFWNGYFPTQDFDYWGQGTTVTVSS

SEQ ID NO: 419 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNEFWNGYFPTQDFDYWGQGTTVTVSS

SEQ ID NO: 420 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNEFWNGYFPTLDFDCWGQGTTVTVSS

SEQ ID NO: 421 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQDRVTITADESTTTAYMELSGLTSDDTAVYYCAREPNEFWNGYFATNDFDYWGQGTTVTVSS

SEQ ID NO: 422 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYATDNFDYWGQGTTVTVSS

SEQ ID NO: 423 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYSTDHFDCWGQGTTVTVSS

SEQ ID NO: 424 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARVPNDFWNGYFATDYFDDWGQGTTVTVSS

SEQ ID NO: 425 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYFATDHFDFWGQGTTVTVSS

SEQ ID NO: 426 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYDTDHFDYWGQGTTVTVSS

SEQ ID NO: 427 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITPILGTANYAQKFQGRVTITADESTTTAYMELSGLTSDDTAVYYCARDPNEFWNGYYATHDFDHWGQGTTVTVSS

SEQ ID NO: 428 - protein, 126 aa, Artificial Sequence
  VH of affinity matured fully human IL-17 antibody IL-17-TN-K7-B6
EVQLVQSGAEVKKPGSSVKISCKASGGSFGSYGISWVRQAPGQGLEWMGGITPFFGWADYAQKFQGRVTITADESTTTAYMELSGLTSDDTAVYYCAREPNEFWNGYYSTDHFDYWGQGTTITVSS

SEQ ID NO: 429 - protein, 126 aa, Artificial Sequence
  VH of affinity matured fully human IL-17 antibody IL-17-TN-K7-B6
EVQLVQSGAEVKKPGESVKISCKASGGSFPSYGISWVRQAPGQGLEWMGGITFFFGAADYAQKFQGRVTITADESTTTAYMELSGLTSDDTAVYYCAREPNDFWNGYYTTHHFDYWGQGTTVTVSS

SEQ ID NO: 430 - protein, 126 aa, Artificial Sequence
  VH of affinity matured fully human IL-17 antibody IL-17-TN-K7-B6
EVQLVQSGAEVKKPGESVKISCKASGGSFISYGTSWVRQAPGQGLEWMGGITHFFGTTDYAQKFQGRVTITADESTTTAYMELSGLTSDDTAVYYCAREPNDFWNGYYTTHHFDYWGQGTTVTVSS

SEQ ID NO: 431 - protein, 126 aa, Artificial Sequence
  VH of affinity matured fully human IL-17 antibody IL-17-TN-K7-B6
EVQLVQSGAEVKKPGESVKISCKASGGSFISYCTSWVRQAPGQGLEWMGGITHFFGSADYAQKFQGRVTITADESTTTAYMELSGLTSDDTAVYYCAREPNDFWNGYYTTHHFDYWGQGTTVTVSS

SEQ ID NO: 432 - protein, 126 aa, Artificial Sequence
  VH of affinity matured fully human IL-17 antibody IL-17-TN-K7-B6
EVQLVQSGAEVKKPGESLKISCKASGGSFRSYSTSWVRQAPGQGLEWMGGITHFFGTADYAQKFQGRVTITADESTTTAYMELSGLTSDDTAVYYCAREPNDFWNGYYTTHHFDYWGQGTTVTVSS

SEQ ID NO: 433 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITHFFGSTDYAQKFQGRVTITADESTTTAYMELSGLTSDDTAVYYCAREPNDFWNGYYTTHHFDYWGQGTTVTVSS

SEQ ID NO: 434 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITHFFGTTDYAQKFQGRVTITADESTTTAYMELSGLTSDDTAVYYCAREPNDFWNGYYTTHHFDYWGQGTTVTVSS

SEQ ID NO: 435 - protein, 126 aa, Artificial Sequence
  VH of affinity matured fully human IL-17 antibody IL-17-TN-K7-B6
EVQLVQSGAEVKKPGESLKISCKASGGSFRSYGISWVRQAPGQGLEWMGGITHFFLTTDYAQKFQGRVTITADESTTTAYMELSGLTSDDTAVYYCAREPNDFWNGYYTTHHFDYWGQGTTVTVSS

SEQ ID NO: 436 - protein, 126 aa, Artificial Sequence
  VH of affinity matured fully human IL-17 antibody IL-17-TN-K7-B6
EVQLVQSGAEVKKPGESLKVSCKASGGSFTSYGISWVRQAPGQGLEWMGGITHMFATTDYAQKFQGRVTITADESTTTAYMELSGLTSDDTAVYYCAREPNDFWNGYYTTHHFDYWGQGTTVTVSS

SEQ ID NO: 437 - protein, 126 aa, Artificial Sequence
  VH of affinity matured fully human IL-17 antibody IL-17-TN-K7-B6
EVQLVQSGAEVKKPGESLKISCKASGGSFISYGISWVRQAPGQGLEWMGGITPFLGATDYAQKFQGRVTITADESTTTAYMELSGLTSDDTAVYYCAREPNDFWNGYYTTHHFDYWGQGTTVTVSS

SEQ ID NO: 438 - protein, 126 aa, Artificial Sequence
  VH of affinity matured fully human IL-17 antibody IL-17-TN-K7-B6
EVQLVQSGAEVKKPGSSLKISCKASGGSFRSYGISWVRQAPGQGLEWMGGITPFFGFIDYAQKFQGRVTITADESTTTAYMELSGLTSDDTAVYYCAREPNDFWNGYYTTHHFDYWGQGTTVTVSS

SEQ ID NO: 439 - protein, 126 aa, Artificial Sequence
  VH of affinity matured fully human IL-17 antibody IL-17-TN-K7-B6
EVQLVQSGAEVKKPGESLKISCKASGGSFRSYVISWVRQAPGQGLEWMGGITPFFGTVDYAQKFQGRVTITADESTTTAYMELSGLTSDDTAVYYCAREPNDFWNGYYTTHHFDYWGQGTTVTVSS

SEQ ID NO: 440 - protein, 126 aa, Artificial Sequence
  VH of affinity matured fully human IL-17 antibody IL-17-TN-K7-B6
EVQLVQSGAEVKKPGESLKISCKASGGSFIVYGFSWVRQAPGQGLEWMGGITPFLGTVDYAQKFQGRVTITADESTTTAYMELSGLTSDDTAVYYCAREPNDFWNGYYTTHHFDYWGQGTTVTVSS

SEQ ID NO: 441 - protein, 126 aa, Artificial Sequence
  VH of affinity matured fully human IL-17 antibody IL-17-TN-K7-B6
EVQLVQSGAEVKKPGESLKVSCKASGGSFLTYGFSWVRQAPGQGLEWMGGITTFLGTVNYAQKFQGRVTITADESTTTAYMELSGLTSDDTAVYYCAREPNDFWNGYYTTHHFDYWGQGTTVTVSS

SEQ ID NO: 442 - protein, 126 aa, Artificial Sequence
  VH of affinity matured fully human IL-17 antibody IL-17-TN-K7-B6
EVQLVQSGAEVKKPGESLKISCKASGGSFTSYVFSWVRQAPGQGLEWMGGITPLLGISDYAQKFQGRVTITADESTTTAYMELSGLTSDDTAVYYCAREPNDFWNGYYTTHHFDYWGQGTTVTVSS

SEQ ID NO: 443 - protein, 126 aa, Artificial Sequence
  VH of affinity matured fully human IL-17 antibody IL-17-TN-K7-B6
EVQLVQSGAEVKKPGESLKISCKASGGSFTSYGVSWVRQAPGQGLEWMGGITTILGTSDYAQKFQGRVTITADESTTTAYMELSGLTSDDTAVYYCAREPNDFWNGYYTTHHFDYWGQGTTVTVSS

SEQ ID NO: 444 - protein, 126 aa, Artificial Sequence
  VH of affinity matured fully human IL-17 antibody IL-17-TN-K7-B6
EVQLVQSGAEVKKPGESLKISCKASGGSFISYGFSWVRQAPGQGLEWMGGITPIFGTGDYAQKFQGRVTITADESTTTAYMELSGLTSDDTAVYYCAREPNDFWNGYYTTHHFDYWGQGTTVTVSS

SEQ ID NO: 445 - protein, 126 aa, Artificial Sequence
  VH of affinity matured fully human IL-17 antibody IL-17-TN-K7-B6
EVQLVQSGAEVKKPGESVKISCKASGGSFWSYDFSWVRQAPGQGLEWMGGITTFFESADYAQKFQGRVTITADESTTTAYMELSGLTSDDTAVYYCAREPNDFWNGYYTTHHFDYWGQGTTVTVSS

SEQ ID NO: 446 - protein, 126 aa, Artificial Sequence
  VH of affinity matured fully human IL-17 antibody IL-17-TN-K7-B6
EVQLVQSGAEVKKPGSSLKISCKASGGSFTSYDFSWVRQAPGQGLEWMGGITTFFGLADYAQKFQGRVTITADESTTTAYMELSGLTSDDTAVYYCAREPNDFWNGYYTTHHFDYWGQGTTVTVSS

SEQ ID NO: 447 - protein, 126 aa, Artificial Sequence
  VH of affinity matured fully human IL-17 antibody IL-17-TN-K7-B6
EVQLVQSGAEVKKPGESLKISCKASGGSFSGYDFSWVRQAPGQGLEWMGGITPFFGSAYYAQKFQGRVTITADESTTTAYMELSGLTSDDTAVYYCAREPNDFWNGYYTTHHFDYWGQGTTVTVSS

SEQ ID NO: 448 - protein, 126 aa, Artificial Sequence
  VH of affinity matured fully human IL-17 antibody IL-17-TN-K7-B6
EVQLVQSGAEVKKPGESLKISCKASGGSFSSYVFSWVRQAPGQGLEWMGGITPFFGIADYAQKFQGRVTITADESTTTAYMELSGLTSDDTAVYYCAREPNDFWNGYYTTHHFDYWGQGTTVTVSS

SEQ ID NO: 449 - protein, 126 aa, Artificial Sequence
  VH of affinity matured fully human IL-17 antibody IL-17-TN-K7-B6
EVQLVQSGAEVKKPGSSVKISCKASGGSFTSYGISWVRQAPGQGLEWMGGITNFFGSTDYAQKFQGRVTITADESTTTAYMELSGLTSDDTAVYYCAREPNDFWNGYYTTHHFDYWGQGTTVTVSS

SEQ ID NO: 450 - protein, 126 aa, Artificial Sequence
  VH of affinity matured fully human IL-17 antibody IL-17-TN-K7-B6
EVQLVQSGAEVKKPGSSVKVSCKASGGSFGSYVISWVRQAPGQGLEWMGGITPFFGSTDYAQKFQGRVTITADESTTTAYMELSGLTSDDTAVYYCAREPNDFWNGYYTTHHFDYWGQGTTVTVSS

SEQ ID NO: 451 - protein, 126 aa, Artificial Sequence
  VH of affinity matured fully human IL-17 antibody IL-17-TN-K7-B6
EVQLVQSGAEVKKPGSSVKVSCKASGGSFSSYGISWVRQAPGQGLEWMGGITHFFGTTDYAQKFQGRVTITADESTTTAYMELSGLTSDDTAVYYCAREPNDFWNGYYTTHHFDYWGQGTTVTVSS

SEQ ID NO: 452 - protein, 126 aa, Artificial Sequence
  VH of affinity matured fully human IL-17 antibody IL-17-TN-K7-B6
EVQLVQSGAEVKKPGSSVKVSCKASGGSFRSYIISWVRQAPGQGLEWMGGITPFFGTADYAQKFQGRVTITADESTTTAYMELSGLTSDDTAVYYCAREPNDFWNGYYTTHHFDYWGQGTTVTVSS

SEQ ID NO: 453 - protein, 126 aa, Artificial Sequence
  VH of affinity matured fully human IL-17 antibody IL-17-TN-K7-B6
EVQLVQSGAEVKKPGSSLKVSCKASGGSFISYGYSWVRQAPGQGLEWMGGITTFFGTTDYAQKFQGRVTITADESTTTAYMELSGLTSDDTAVYYCAREPNDFWNGYYTTHHFDYWGQGTTVTVSS

SEQ ID NO: 454 - protein, 126 aa, Artificial Sequence
  VH of affinity matured fully human IL-17 antibody IL-17-TN-K7-B6
EVQLVQSGAEVKKPGSSVKVSCKASGGSFISYGYNWVRQAPGQGLEWMGGITPFFGTADYAQKFQGRVTITADESTTTAYMELSGLTSDDTAVYYCAREPNDFWNGYYTTHHFDYWGQGTTVTVSS

SEQ ID NO: 455 - protein, 126 aa, Artificial Sequence
  VH of affinity matured fully human IL-17 antibody IL-17-TN-K7-B6
EVQLVQSGAEVKKPGSSVKVSCKASGGSFLSYGFSWVRQAPGQGLEWMGGITPFFGFADYAQKFQGRVTITADESTTTAYMELSGLTSDDTAVYYCAREPNDFWNGYYTTHHFDYWGQGTTVTVSS

SEQ ID NO: 456 - protein, 126 aa, Artificial Sequence
  VH of affinity matured fully human IL-17 antibody IL-17-TN-K7-B6
EVQLVQSGAEVKKPGESVKVSCKASGGSFSSYVFSWVRQAPGQGLEWMGGITPFFGTADYAQKFQGRVTITADESTTTAYMELSGLTSDDTAVYYCAREPNDFWNGYYTTHHFDYWGQGTTVTVSS

SEQ ID NO: 457 - protein, 126 aa, Artificial Sequence
  VH of affinity matured fully human IL-17 antibody IL-17-TN-K7-B6
EVQLVQSGAEVKKPGSSVKVSCKASGGSFISYDYSWVRQAPGQGLEWMGGITPFFGIVNYAQKFQGRVTITADESTTTAYMELSGLTSDDTAVYYCAREPNDFWNGYYTTHHFDYWGQGTTVTVSS

SEQ ID NO: 458 - protein, 126 aa, Artificial Sequence
  VH of affinity matured fully human IL-17 antibody IL-17-TN-K7-B6
EVQLVQSGAEVKKPGESVKVSCKASGGSFGSYDYSWVRQAPGQGLEWMGGITTFFGASTYAQKFQGRVTITADESTTTAYMELSGLTSDDTAVYYCAREPNDFWNGYYTTHHFDYWGQGTTVTVSS

SEQ ID NO: 459 - protein, 126 aa, Artificial Sequence
  VH of affinity matured fully human IL-17 antibody IL-17-TN-K7-B6
EVQLVQSGAEVKKPGSSVKISCKASGGSFHSYDYSWVRQAPGQGLEWMGGITSFFGTEDYAQKFQGRVTITADESTTTAYMELSGLTSDDTAVYYCAREPNDFWNGYYTTHHFDYWGQGTTVTVSS

SEQ ID NO: 460 - protein, 126 aa, Artificial Sequence
  VH of affinity matured fully human IL-17 antibody IL-17-TN-K7-B6
EVQLVQSGAEVKKPGSSVKISCKASGGSFTGYVYSWVRQAPGQGLEWMGGITPFFGTADYAQKFQGRVTITADESTTTAYMELSGLTSDDTAVYYCAREPNDFWNGYYTTHHFDYWGQGTTVTVSS

SEQ ID NO: 461 - protein, 126 aa, Artificial Sequence
  VH of affinity matured fully human IL-17 antibody IL-17-TN-K7-B6
EVQLVQSGAEVKKPGESVKVSCKASGGSFTSYDFSWVRQAPGQGLEWMGGITPFLGTAIYAQKFQGRVTITADESTTTAYMELSGLTSDDTAVYYCAREPNDFWNGYYTTHHFDYWGQGTTVTVSS

SEQ ID NO: 462 - protein, 126 aa, Artificial Sequence
  VH of affinity matured fully human IL-17 antibody IL-17-TN-K7-B6
EVQLVQSGAEVKKPGESVKISCKASGGSFSSYDFSWVRQAPGQGLEWMGGITPILGTENYAQKFQGRVTITADESTTTAYMELSGLTSDDTAVYYCAREPNDFWNGYYTTHHFDYWGQGTTVTVSS

SEQ ID NO: 463 - protein, 126 aa, Artificial Sequence
  VH of affinity matured fully human IL-17 antibody IL-17-TN-K7-B6
EVQLVQSGAEVKKPGESVKISCKASGGSFSSYDYSWVRQAPGQGLEWMGGITPFLGMSSYAQKFQGRVTITADESTTTAYMELSGLTSDDTAVYYCAREPNDFWNGYYTTHHFDYWGQGTTVTVSS

SEQ ID NO: 464 - protein, 126 aa, Artificial Sequence
  VH of affinity matured fully human IL-17 antibody IL-17-TN-K7-B6
EVQLVQSGAEVKKPGESLKISCKASGGSFTRYDFSWVRQAPGQGLEWMGGITPFLGTSNYAQKFQGRVTITADESTTTAYMELSGLTSDDTAVYYCAREPNDFWNGYYTTHHFDYWGQGTTVTVSS

SEQ ID NO: 465 - protein, 126 aa, Artificial Sequence
  VH of affinity matured fully human IL-17 antibody IL-17-TN-K7-B6
EVQLVQSGAEVKKPGSSLKISCKASGGSFISYDFSWVRQAPGQGLEWMGGITPFLGFSNYAQKFQGRVTITADESTTTAYMELSGLTSDDTAVYYCAREPNDFWNGYYTTHHFDYWGQGTTVTVSS

SEQ ID NO: 466 - protein, 126 aa, Artificial Sequence
  VH of affinity matured fully human IL-17 antibody IL-17-TN-K7-B6
EVQLVQSGAEVKKPGSSVKISCKASGGSFSSYDFSWVRQAPGQGLEWMGGITPFLGTADYAQKFQGRVTITADESTTTAYMELSGLTSDDTAVYYCAREPNDFWNGYYTTHHFDYWGQGTTVTVSS

SEQ ID NO: 467 - protein, 126 aa, Artificial Sequence
  VH of affinity matured fully human IL-17 antibody IL-17-TN-K7-B6
EVQLVQSGAEVKKPGSSVKISCKASGGSFSSYDFSWVRQAPGQGLEWMGGITTFLGTVVYAQKFQGRVTITADESTTTAYMELSGLTSDDTAVYYCAREPNDFWNGYYTTHHFDYWGQGTTVTVSS

SEQ ID NO: 468 - protein, 126 aa, Artificial Sequence
  VH of affinity matured fully human IL-17 antibody IL-17-TN-K7-B6
EVQLVQSGAEVKKPGSSVKISCKASGGSFSSYVVSWVRQAPGQGLEWMGGITPFLGTVDYAQKFQGRVTITADESTTTAYMELSGLTSDDTAVYYCAREPNDFWNGYYTTHHFDYWGQGTTVTVSS

SEQ ID NO: 469 - protein, 126 aa, Artificial Sequence
  VH of affinity matured fully human IL-17 antibody IL-17-TN-K7-B6
EVQLVQSGAEVKKPGSSVKISCKASGGSFISYGFHWVRQAPGQGLEWMGGITPFFGTDNYAQKFQGRVTITADESTTTAYMELSGLTSDDTAVYYCAREPNDFWNGYYTTHHFDYWGQGTTVTVSS

SEQ ID NO: 470 - protein, 126 aa, Artificial Sequence
  VH of affinity matured fully human IL-17 antibody IL-17-TN-K7-B6
EVQLVQSGAEVKKPGESVKISCKASGGSFISYGFSWVRQAPGQGLEWMGGITPFFGLGTYAQKFQGRVTITADESTTTAYMELSGLTSDDTAVYYCAREPNDFWNGYYTTHHFDYWGQGTTVTVSS

SEQ ID NO: 471 - protein, 126 aa, Artificial Sequence
  VH of affinity matured fully human IL-17 antibody IL-17-TN-K7-B6
EVQLVQSGAEVKKPGESVKISCKASGGSFLSYDFSWVRQAPGQGLEWMGGITPFFGAANYAQKFQGRVTITADESTTTAYMELSGLTSDDTAVYYCAREPNDFWNGYYTTHHFDYWGQGTTVTVSS

SEQ ID NO: 472 - protein, 126 aa, Artificial Sequence
  VH of affinity matured fully human IL-17 antibody IL-17-TN-K7-B6
EVQLVQSGAEVKKPGESVKISCKASGGSFLSYGFSWVRQAPGQGLEWMGGITPFFGTADYAQKFQGRVTITADESTTTAYMELSGLTSDDTAVYYCAREPNDFWNGYYTTHHFDYWGQGTTVTVSS

SEQ ID NO: 473 - protein, 107 aa, Artificial Sequence
  VL of affinity matured fully human IL-17 antibody IL-17-TN-K7-B6
EIVLTQSPDFQSVTPKEKVTITCRASQIIGSELHWYQQKPDQSPKLLIKYASHSISGVPSRFSGSGSGTDFTLTINGLEAEDAGTYYCHQSYDLPHTFGQGTKVDIK

SEQ ID NO: 474 - protein, 107 aa, Artificial Sequence
  VL of affinity matured fully human IL-17 antibody IL-17-TN-K7-B6
EIVLTQPPDFQSVTPKEKVTITCRASQDIGSELHWYQQKPDQSPKLLIKYASHSISGVPSRFSGSGSGTDFTLTINGLEAEDAGTYYCHQSYDLPYTFGQGTKVDIK

SEQ ID NO: 475 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSISGVPSRFSGSGSGTDFTLTINSLEAEDAGTYYCHQSYWLPNTFGQGTKVDIK

SEQ ID NO: 476 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSGSGVPSRFSGSGSGTDFTLTINSLEAEDAATYYCHQSYNLPITFGQGTKVDIK

SEQ ID NO: 477 - protein, 107 aa, Artificial Sequence; identical to SEQ ID NO: 476
  VL of affinity matured fully human IL-17 antibody IL-17-TN-K7-B6

SEQ ID NO: 478 - protein, 107 aa, Artificial Sequence
  VL of affinity matured fully human IL-17 antibody IL-17-TN-K7-B6
EIVLTQSPDFQSVTLKEKVTITCRASQDIGSELHWYQQKPDQSPKLLIKYASNSISGVPSRFSGSGSGTDFTLTINGLEAEDAGTYYCHQSMSLPHTFGQGTKVDIK

SEQ ID NO: 479 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKVDIK

SEQ ID NO: 480 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLIKYASQSISGVPPRFSGSGSGTDFTLTINGLEAEDAGTYYCHQSTSLPHTFGQGTKVDIK

SEQ ID NO: 481 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLIKYASQSISGVPSRFSGSGSGADFTLTINGLEAEDAGTYYCHQSTSLPHTFGQGTKVDIK

SEQ ID NO: 482 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLIKYASQSISGVPSRFGGSGSGTDFTLTINGLEAEDAGTYYCHQSTSLPHTFGQGTKVDIK

SEQ ID NO: 483 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLVKYASQSISGVPSRFSGSGSGTDFTLTINGLEAEDAGTYYCHQSTSLPHTFGQGTKVDIK

SEQ ID NO: 484 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQPPKLLIKYASQSISGVPSRFSGSGSGTDFTLTINGLEAEDAGTYYCHQSTSLPHTFGQGTKVDIK

SEQ ID NO: 485 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPGQSPKLLIKYASQSISGVPSRFSGSGSGTDFTLTINGLEAEDAGTYYCHQSTSLPHTFGQGTKVDIK

SEQ ID NO: 486 - protein, 107 aa, Artificial Sequence
  VL of affinity matured fully human IL-17 antibody IL-17-TN-K7-B6
EIVLTQSPDFQSATPKEKVTITCRASQNIGSALHWYQQKPDQSPKLLIKYASQSISGVPSRFSGSGSGTDFTLTINGLEAEDAGTYYCHQGTSLPHTFGQGTKVDIK

SEQ ID NO: 487 - protein, 107 aa, Artificial Sequence
  VL of affinity matured fully human IL-17 antibody IL-17-TN-K7-B6
EIVLTQSPDFQSVTPKEKVTITCRASQNIGSALHWYQQKPDQSPKLLIKYASQSISGVPSRFSGSGSGTDFTLTINGLEAEDAGTYYCHQGTSLPHTFGQGTKVDIK

SEQ ID NO: 488 - protein, 107 aa, Artificial Sequence
  VL of affinity matured fully human IL-17 antibody IL-17-TN-K7-B6
EIVLTQSPDFQSVTPKEKVTITCRASQDIGSALHWYQQKPDQSPKLLIKYASQSISGVPSRFSGSGSGTDFTLTINGLEAEDAGTYYCHQSTSLPHTFGQGTKVDIK

SEQ ID NO: 489 - protein, 107 aa, Artificial Sequence
  VL of affinity matured fully human IL-17 antibody IL-17-TN-K7-B6
EIVLTQSPDFQSVTPKEKVTITCRASQDIGSALHWYQQKPDQSPKLLIKYASHSVSGVPSRFSGSGSGTDFTLTINGLEAEDAGTYYCHQSDILPHTFGPGTKVDIK

SEQ ID NO: 490 - protein, 107 aa, Artificial Sequence
  VL of affinity matured fully human IL-17 antibody IL-17-TN-K7-B6
EIVLTQSPDFQSVTPKGKVTITCRASQDIGSALHWYQQKPDQSPKLLIKYASYSVSGVPSRFSGSGSGTDFTLTINGLEAEDAGTYYCHQSDILPHTFGPGTKVDIK

SEQ ID NO: 491 - protein, 107 aa, Artificial Sequence
  VL of affinity matured fully human IL-17 antibody IL-17-TN-K7-B6
EIVLTQSPDFQSVTPKEKVTITCRASQDIGAALHWYQQKPDQSPKLLIKYASHSNPGVPSRFSGSGSGTDFTLTINGLEAEDAGTYYCHQSDILPQTFGQGTKVDIK

SEQ ID NO: 492 - protein, 107 aa, Artificial Sequence
  VL of affinity matured fully human IL-17 antibody IL-17-TN-K7-B6
EIVLTQSPDFQSVTPKEKVTITCRASQNIGSSLHWYQQKPDQSPKLLIKYASHSISGVPSRFSGSGSGTDFTLTINGLEAEDAGTYYCHQSDFLPHTFGQGTKVDIK

SEQ ID NO: 493 - protein, 107 aa, Artificial Sequence
  VL of affinity matured fully human IL-17 antibody IL-17-TN-K7-B6
EIVLTQSPDFQSVTPKEKVTITCRASQNIGSSLHWYQQKPDQSPKLLIKYASYPISGVPSRFSGSGSGTDFTLTINGLEAEDAGTYYCHQSDILPHTFGQGTKVDIK

SEQ ID NO: 494 - protein, 107 aa, Artificial Sequence
  VL of affinity matured fully human IL-17 antibody IL-17-TN-K7-B6
EIVLTQSPDFRSVTPKEKVTITCRASQNIGSALHWYQQKPDQSPKLLIKYASHSISGVPSRFSGSGSGTDFTLTINGLEAEDAGTYYCHQSDDLPYTFGQGTKVDIK

SEQ ID NO: 495 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSNSGVPSRFSGSGSGTDFTLTINGLEAEDAGTYYCHQSSWLPHTFGPGTKVDIK

SEQ ID NO: 496 - protein, 106 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASESMSGVPSRFSGSGSGTDFTLTINGLEAEDAGTYYCHQSSLPHSFGPGTKVDIK

SEQ ID NO: 497 - protein, 107 aa, Artificial Sequence
  VL of affinity matured fully human IL-17 antibody IL-17-TN-K7-B6
EIVLTQSPDFQSVTPKEKVTITCRASQDIGYELHWYQQKPDQSPKLLIKYASHSISGVPSRFSGSGSGTDFTLTINGLEAEDAGTYYCHQSSELPHTFGRGTKVDIK

SEQ ID NO: 498 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPGQSPKLLIKYASYSSSGVPSRFSGSGSGTDFTLTINGLEAEDAGTYYCHQSSCLPHTFGQGTKVGIK

SEQ ID NO: 499 - protein, 107 aa, Artificial Sequence
  VL of affinity matured fully human IL-17 antibody IL-17-TN-K7-B6
EIVLTQSPDFQSVTPKEKVTITCRASQEIGFALHWYQQKPGQSPKLLIKYASHSISGVPSRFSGSGSGTDFTLTINGLEAEDAGTYYCHQTEELPYTFGPGTKVDIK

SEQ ID NO: 500 - protein, 107 aa, Artificial Sequence
  VL of affinity matured fully human IL-17 antibody IL-17-TN-K7-B6
EIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIK

SEQ ID NO: 501 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSISGVPSRFSGSGSGTDFTLTINGLEAEDAGTYYCHQTFSLPYTFGPGTKVDIK

SEQ ID NO: 502 - protein, 107 aa, Artificial Sequence
  VL of affinity matured fully human IL-17 antibody IL-17-TN-K7-B6
DIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIK

SEQ ID NO: 503 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSVSGVPSRFSGSGSGTDFTLTINGLEAEDAGTYYCHQTSDLPYTFGPGTKVDIK

SEQ ID NO: 504 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSMSGVPSRFSGSGSGTDFTLTINGLEAEDAATYYCHQTNSLPYTFGPGTKVDIK

SEQ ID NO: 505 - protein, 107 aa, Artificial Sequence
  VL of affinity matured fully human IL-17 antibody IL-17-TN-K7-B6
EIVLTQSPDFQSVTPKEKVTITCRASQDIGSGLHWYQQKPDQSPKLLIKYASESMSGVPSRFSGSGSGTDFTLTINGLEAEDAATYYCHQTDWLPYTFGPGTKVDIK

SEQ ID NO: 506 - protein, 107 aa, Artificial Sequence
  VL of affinity matured fully human IL-17 antibody IL-17-TN-K7-B6
EIVLTQSPDFQSVTPREKVTITCRASQDIGSDLHWYQQKPDQSPKLLIKYASHSISGVPSRFSGSGSGTDFTLTINGLEAEDAGTYYCHQTNSLPYTFGQGTKVDIK

SEQ ID NO: 507 - protein, 107 aa, Artificial Sequence
  VL of affinity matured fully human IL-17 antibody IL-17-TN-K7-B6
EIVLTQSPDFQSVTPKEKVTITCRASQDIDSDLHWYQQKPDQSPKLLIKYASHSISGVPSRFSGSGSGTDFTLTINGLEAEDAGTYYCHQTFNLPYTFGPGTKVDIK

SEQ ID NO: 508 - protein, 107 aa, Artificial Sequence
  VL of affinity matured fully human IL-17 antibody IL-17-TN-K7-B6
EIVLTQSPDFQSVTPKEKVTITCRASQDIGSDLHWYQQKPDQSPKLLIKYASNSISGVPSRFSGSGSGTDFTLTINGLEAEDAGTYYCHQTAYLPQTFGPGTIVDIK

SEQ ID NO: 509 - protein, 107 aa, Artificial Sequence
  VL of affinity matured fully human IL-17 antibody IL-17-TN-K7-B6
EIVLTQSPDFQSVTPKEKVTITCRASQDIGSDLHWYQQKPDQSPKLLIKYASYSTSGVPSRFSGSGSGTDFTLTINGLEAEDAGTYYCHQTDGLPYTFGQGTKVDIK

SEQ ID NO: 510 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASESISGVPSRFSGSGSGTDFTLTINGLEAEDAGTYYCHQTDSLPYTFGQGTKVDIK

SEQ ID NO: 511 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSASGVPSRFSGSGSGTDFTLTINGLEAEDAGTYYCHQTTLLPYTFGQGTKVDIK

SEQ ID NO: 512 - protein, 107 aa, Artificial Sequence
  VL of affinity matured fully human IL-17 antibody IL-17-TN-K7-B6
EIVLTQSPDFQSVTPKGKVTITCRASQDIGSELHWYQQKPDQSPKLLIKYASHSGSGVPSRFSGSGSGTDFTLTINGLEAEDAGTYYCHQGFSLPHTFGQGTKVDIK

SEQ ID NO: 513 - protein, 107 aa, Artificial Sequence
  VL of affinity matured fully human IL-17 antibody IL-17-TN-K7-B6
EVVLTQSPDFQSVTPKEKVTITCRASQDIGSELHWYQQKPDQSPKLLIKYASESGSGVPSRFSGSGSGTDFTLTINGLEAEDAGTYYCHQSFCLPYTFGQGTKVDIK

SEQ ID NO: 514 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASSSTSGVPSRFSGSGSGTDFTLTINGLEAEDAGTYYCHQSTSLPYTFGQGTKVDIK

SEQ ID NO: 515 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASSSLSGVPSRFSGSGSGTDFTLTINGLEAEDAGTYYCHQSDYLPYTFGQGTIVDIK

SEQ ID NO: 516 - protein, 107 aa, Artificial Sequence
  VL of affinity matured fully human IL-17 antibody IL-17-TN-K7-B6
EIVLTQSPDFQSVTPKEKVTITCRASQDIGEALHWYQQKPDQSPKLLIKYASHSISGVPSRFSGSGSGTDFTLTINGLEAEDAATYYCHQSDWLPYTFGQGTKVDIK

SEQ ID NO: 517 - protein, 107 aa, Artificial Sequence
  VL of affinity matured fully human IL-17 antibody IL-17-TN-K7-B6
EIVLTQSPDFQSVTPKEKVTITCRASQEIGASLHWYQQKPDQSPKLLIKYASHSASGVPSRFSGSGSGTDFTLTINSLEAEDAATYYCHQSDGLPYTFGQGTKVDIK

SEQ ID NO: 518 - protein, 107 aa, Artificial Sequence
  VL of affinity matured fully human IL-17 antibody IL-17-TN-K7-B6
EIVLTQSPDFQSVTPKEKVTITCRASQDIGGELHWYQQKPDQSPKLLIKYASHSISGVPSRFSGSGSGTDFTLTINGLEAEDAATYYCHQSNDLPYTFGQGTKVDIK

SEQ ID NO: 519 - protein, 107 aa, Artificial Sequence
  VL of affinity matured fully human IL-17 antibody IL-17-TN-K7-B6
EIVLTQSPDFQSVTPKEKVTITCRASQDIETELHWYQQKPDQSPKLLIKYASHSISGVPSRFSGSGSGTDFTLTINGLEAEDAATYYCHQTYGLPYTFGQGTKVDIK

SEQ ID NO: 520 - protein, 107 aa, Artificial Sequence
  VL of affinity matured fully human IL-17 antibody IL-17-TN-K7-B6
EIVLTQSPDFQSVTPKEKVTITCRASQNIGSDLHWYQQKPDQSPKLLIKYASHSISGVPSRFSGSGSGTDFTLTINGLEAEDAATYYCHQSMGLPYTFGQGTKVDIK

SEQ ID NO: 521 - protein, 107 aa, Artificial Sequence
  VL of affinity matured fully human IL-17 antibody IL-17-TN-K7-B6
EIVLTQSPDFQSVTPKEKVTITCRASQNIGYELHWYQQKPDQSPKLLIKYASHSISGVPSRFSGSGSGTDFTLTINGLEAEDAATYYCHQSFTLPYTFGPGTKVDIK

SEQ ID NO: 522 - protein, 107 aa, Artificial Sequence
  VL of affinity matured fully human IL-17 antibody IL-17-TN-K7-B6
EIVLTQSPDFQSVTPKEKVTITCRASQNIGTELHWYQQKPDQSPKLLIKYASHCISGVPSRFSGSGSGTDFTLTINGLEAEDAATYYCHQSESLPHTFGQGTKVDIK

SEQ ID NO: 523 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIK

SEQ ID NO: 524 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASESVSGVPSRFSGSGSGTDFTLTINGLEAEDAATYYCHQSTNLPYTFGQGTKVDIK

SEQ ID NO: 525 - protein, 107 aa, Artificial Sequence
  VL of affinity matured fully human IL-17 antibody IL-17-TN-K7-B6
EIVLTQSPDFQSVTPKEKVTITCRASQDIGSELHWYQQKPDQSPKLLIKYASHSVSGVPSRFSGSGSGTDFTLTINGLEAEDAATYYCHQSSILPHTFGQGTKVDIK

SEQ ID NO: 526 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSVSGVPSRFSGSGSGTDFTLTINGLEAEDAATYYCHQSTWLPYTFGQGTKVDIK

SEQ ID NO: 527 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSVSGVPSRFSGSGSGTDFTLTINGLEAEDAATYYCHQSAFLPYIFGQGTKVDIK

SEQ ID NO: 528 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASYSVSGVPSRFSGSGSGTDFTLTINGLEAEDAATYYCHQSISLPQTFGQGTKVDIK

SEQ ID NO: 529 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSTSGVPSRFSGSGSGTDFTLTINGLEAEDAATYYCHQSASLPITFGQGTKVDIK

SEQ ID NO: 530 - protein, 107 aa, Artificial Sequence
  VL of affinity matured fully human IL-17 antibody IL-17-TN-K7-B6
EIVLTQSPDFQSVTPKEKVTITCRASQNIGSGLHWYQQKPDQSPKLLIKYASYSISGVPSRFSGSGSGTDFTLTINGLEAEDAGTYYCHQSAYLPYTFGPGTKVDIK

SEQ ID NO: 531 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSISGVPSRFSGSGSGTDFTLTINGLEAEDAGTYYCHQSAVLPDTFGPGTKVDIK

SEQ ID NO: 532 - protein, 107 aa, Artificial Sequence
  VL of affinity matured fully human IL-17 antibody IL-17-TN-K7-B6
EIVLTQSPDFQSVAPKEKVTITCRASQNIGSELHWYQQKPDQSPKLLIKYASSSISGVPSRFSGSGSGTDFTLTINGLEAEDAGTYYCHQSSDLPYTFGPGTKVDIK

SEQ ID NO: 533 - protein, 107 aa, Artificial Sequence
  VL of affinity matured fully human IL-17 antibody IL-17-TN-K7-B6
EIVLTQSPDFQSVTPKEKVTITCRASQNIDSELHWYQQKPDQSPKLLIKYASESISGVPSRFSGSGSGTDFALTINGLEAEDAGTYYCHQSFSLPYTFGPGTKVDIK

SEQ ID NO: 534 - protein, 107 aa, Artificial Sequence
  VL of affinity matured fully human IL-17 antibody IL-17-TN-K7-B6
EIVLTQSPDFQSVTPKEKVTITCRASQNIDSELHWYQQKPDQSPKLLIKYASESISGVPSRFSGSGSGTDFTLTINGLEAEDAGTYYCHQSAFLPYTFGQGTKVDIK

SEQ ID NO: 535 - protein, 107 aa, Artificial Sequence
  VL of affinity matured fully human IL-17 antibody IL-17-TN-K7-B6
EIVLTQSPDFQSVTPKEKVTITCRASQNIDSDLHWYQQKPDQSPKLLIKYASHSVSGVPSRFSGSGSGTDFTLTINGLEAEDAGTYYCHQSYSLPFNFGPGTKVDIK

SEQ ID NO: 536 - protein, 107 aa, Artificial Sequence
  VL of affinity matured fully human IL-17 antibody IL-17-TN-K7-B6
EIVLTQSPDFQSVTPKEKVTITCRASQNIGSELHWYQQKPDQSPKLLIKYASHSVSGVPSRFSGSGSGTDFTLTINGLEAEDAGTYYCHQSYMLPYSFGPGTKVDIK

SEQ ID NO: 537 - protein, 107 aa, Artificial Sequence
  VL of affinity matured fully human IL-17 antibody IL-17-TN-K7-B6
EIVLTQSPDFQSVTPKEKVTITCRASQNIGEELHWYQQKPDQSPKLLIKYASSSPSGVPSRFSGSGSGTDFTLTINGLEAEDAGTYYCHQSFSLPVTFGPGTKVDIK

SEQ ID NO: 538 - protein, 107 aa, Artificial Sequence
  VL of affinity matured fully human IL-17 antibody IL-17-TN-K7-B6
EIVLTQSPDFQSVAPKEKVTITCRASQNIGSELHWYQQKPDQSPKLLIKYASHSVSGVPSRFSGSGSGTDFTLTINGLEAEDAGTYYCHQSISLPYTFGQGTKVDIK

SEQ ID NO: 539 - protein, 107 aa, Artificial Sequence
  VL of affinity matured fully human IL-17 antibody IL-17-TN-K7-B6
EIVLTQSPDFQSVTPKEKVTITCRASQAIGSELHWYQQKPDQSPKLLIKYASYSVSGVPSRFSGSGSGTDFTLTINGLEAEDAGTYYCHQSASLPYTFGQGTKVDIK

SEQ ID NO: 540 - protein, 5 aa, Artificial Sequence
  CDR-H1 consensus sequence from antibody IL-17-TN-K7-B6
  MISC_FEATURE (1)..(1): S, G, T, V, or R
  MISC_FEATURE (3)..(3): G, D, V, S, A, C, or I
  MISC_FEATURE (4)..(4): I, F, T, Y, M, or V
  MISC_FEATURE (5)..(5): S, G, C, N, V, or H
XYXXX

SEQ ID NO: 541 - protein, 17 aa, Artificial Sequence
  CDR-H2 consensus sequence from antibody IL-17-TN-K7-B6
  MISC_FEATURE (2)..(2): I or V
  MISC_FEATURE (4)..(4): P, H, N, T, L, I, V, S, or F
  MISC_FEATURE (5)..(5): F, I, M, V, S, or L
  MISC_FEATURE (6)..(6): F or L
  MISC_FEATURE (7)..(7): G, M, L, E, or A
  MISC_FEATURE (8)..(8): T, I, S, W, A, F, L, M, V, or H
  MISC_FEATURE (9)..(9): A, T, V, S, E, D, P, I, G, or R
  MISC_FEATURE (10)..(10): D, N, Y, S, T, V, or I
  MISC_FEATURE (17)..(17): G or D
GXTXXXXXXXYAQKFQX

SEQ ID NO: 542 - protein, 17 aa, Artificial Sequence
  CDR-H3 consensus sequence from antibody IL-17-TN-K7-B6
  MISC_FEATURE (1)..(1): E, D, or V
  MISC_FEATURE (2)..(2): P, S, or T
  MISC_FEATURE (3)..(3): N, S, T, or H
  MISC_FEATURE (4)..(4): E, D, or A
  MISC_FEATURE (10)..(10): Y or F
  MISC_FEATURE (11)..(11): T, A, S, D, P, N, C, or V
  MISC_FEATURE (13)..(13): H, D, Q, N, or L
  MISC_FEATURE (14)..(14): D, H, Y, or N
  MISC_FEATURE (15)..(15): F, L, or Y
  MISC_FEATURE (17)..(17): Y, S, L, N, F, C, I, H, A, or D
XXXXFWNGYXXTXXXDX

SEQ ID NO: 543 - protein, 11 aa, Artificial Sequence
  CDR-L1 consensus sequence from antibody IL-17-TN-K7-B6
  MISC_FEATURE (1)..(1): R or W
  MISC_FEATURE (2)..(2): A or V
  MISC_FEATURE (5)..(5): N, D, E, A, or I
  MISC_FEATURE (7)..(7): G, D, or E
  MISC_FEATURE (8)..(8): S, Y, A, E, F, T, or G
  MISC_FEATURE (9)..(9): A, E, D, S, or G
XXSQXIXXXLH

SEQ ID NO: 544 - protein, 7 aa, Artificial Sequence
  CDR-L2 consensus sequence from antibody IL-17-TN-K7-B6
  MISC_FEATURE (4)..(4): H, Q, Y, E, N, S, or W
  MISC_FEATURE (5)..(5): S, P, or C
  misc_feature (6)..(6): Xaa can be any naturally occurring amino acid
  MISC_FEATURE (7)..(7): S or P
YASXXXX

SEQ ID NO: 545 - protein, 9 aa, Artificial Sequence
  CDR-L3 consensus sequence from antibody IL-17-TN-K7-B6
  MISC_FEATURE (3)..(3): S, T, or G
  MISC_FEATURE (4)..(4): T, D, A, Y, S, F, N, I, E, or M
  MISC_FEATURE (5)..(5): S, D, N, G, I, T, F, Y, W, C, E, R, V, L, or M
  MISC_FEATURE (8)..(8): H, Y, Q, F, I , V, D, or N
  MISC_FEATURE (9)..(9): T, S, A, I, N, or L
HQXXXLPXX

SEQ ID NO: 546 - protein, 126 aa, Artificial Sequence; identical to SEQ ID NO: 403
  VH region of IL-17 antibody B6.1-5

SEQ ID NO: 547 - protein, 107 aa, Artificial Sequence; identical to SEQ ID NO: 523
  Vk region of IL-17 antibody B6.1-5

SEQ ID NO: 548 - protein, 126 aa, Artificial Sequence; identical to SEQ ID NO: 383
  VH region of IL-17 antibody B6.1-15

SEQ ID NO: 549 - protein, 107 aa, Artificial Sequence; identical to SEQ ID NO: 500
  Vk region of IL-17 antibody B6.1-15

SEQ ID NO: 550 - protein, 126 aa, Artificial Sequence; identical to SEQ ID NO: 368
  VH region of IL-17 antibody B6.1-16

SEQ ID NO: 551 - protein, 107 aa, Artificial Sequence; identical to SEQ ID NO: 489
  Vk region of IL-17 antibody B6.1-16

SEQ ID NO: 552 - protein, 126 aa, Artificial Sequence; identical to SEQ ID NO: 389
  VH region of IL-17 antibody B6.1-17

SEQ ID NO: 553 - protein, 107 aa, Artificial Sequence
  Vk region of IL-17 antibody B6.1-17
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIK

SEQ ID NO: 554 - protein, 126 aa, Artificial Sequence; identical to SEQ ID NO: 372
  VH region of IL-17 antibody B6.1-18

SEQ ID NO: 555 - protein, 107 aa, Artificial Sequence; identical to SEQ ID NO: 517
  Vk region of IL-17 antibody B6.1-18

SEQ ID NO: 556 - protein, 126 aa, Artificial Sequence; identical to SEQ ID NO: 377
  VH region of IL-17 antibody B6.1-46

SEQ ID NO: 557 - protein, 107 aa, Artificial Sequence; identical to SEQ ID NO: 539
  Vk region of IL-17 antibody B6.1-46

SEQ ID NO: 558 - protein, 126 aa, Artificial Sequence; identical to SEQ ID NO: 407
  VH region of IL-17 antibody B6.1-44

SEQ ID NO: 559 - protein, 107 aa, Artificial Sequence
  Vk region of IL-17 antibody B6.1-44
EIVLTQSPDFQSVTPKEKVTITCRASQDIGSDLHWYQQKPDQSPKLLIKYASNSISGVPSRFSGSGSGTDFTLTINGLEAEDAGTYYCHQTAYLPQTFGPGTKVDIK

SEQ ID NO: 560 - protein, 126 aa, Artificial Sequence; identical to SEQ ID NO: 455
  VH region of IL-17 antibody B6.11

SEQ ID NO: 561 - protein, 126 aa, Artificial Sequence; identical to SEQ ID NO: 454
  VH region of IL-17 antibody B6.29

SEQ ID NO: 562 - protein, 253 aa, Artificial Sequence
  Dual VH regions of the DVD-Ig, D2-GS6-B6 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYTTHHFDYWGQGTPVTVSS

SEQ ID NO: 563 - protein, 121 aa, Artificial Sequence [sequence omitted]

SEQ ID NO: 564 - protein, 6 aa, Artificial Sequence
  linker segment of VH region of the DVD-Ig, D2-GS6-B6 DVD
GGGGSG

SEQ ID NO: 565 - protein, 126 aa, Artificial Sequence; identical to SEQ ID NO: 46
  VH region of IL-17 antibody B6

SEQ ID NO: 566 - protein, 330 aa, Artificial Sequence [sequence omitted]

SEQ ID NO: 567 - protein, 221 aa, Artificial Sequence
  Dual VL regions of the DVD-Ig, E7-GS6-B6 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGDVVMTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKLDIKR

SEQ ID NO: 568 - protein, 108 aa, Artificial Sequence
  VL region of TNF antibody D2E7
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 569 - protein, 5 aa, Artificial Sequence
  VL linker segment of the DVD-Ig, E7-SL-B6 DVD
GGSGG

SEQ ID NO: 570 - protein, 108 aa, Artificial Sequence; identical to SEQ ID NO: 47
  VL region of IL-17 antibody B6

SEQ ID NO: 571 - protein, 106 aa, Artificial Sequence; identical to SEQ ID NO: 5
  CL region of the DVD-Ig, E7-SL-B6 DVD

SEQ ID NO: 572 - protein, 253 aa, Artificial Sequence
  Dual VH regions of the DVD-Ig, D2-SL-B6 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVQSGAEVKKPGESLKISCKASGGSFRSYGISWVRQAPGQGLEWMGGITPILGTANYAQKFQGRVTITADESTTTAYMELSGLTSDDTAVYYCAREPNDFWNGYYTTHHFDYWGQGTPVTVSS

SEQ ID NO: 573 - protein, 121 aa, Artificial Sequence [sequence omitted]

SEQ ID NO: 574 - protein, 6 aa, Artificial Sequence
  VH linker of the DVD-Ig, D2-SL-B6 DVD
ASTKGP

SEQ ID NO: 575 - protein, 126 aa, Artificial Sequence; identical to SEQ ID NO: 46
  VH region of IL-17 antibody B6

SEQ ID NO: 576 - protein, 330 aa, Artificial Sequence [sequence omitted]

SEQ ID NO: 577 - protein, 252 aa, Artificial Sequence
  Dual VH regions of the DVD-Ig, D2-GS6-G9 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEEVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 578 - protein, 121 aa, Artificial Sequence [sequence omitted]

SEQ ID NO: 579 - protein, 6 aa, Artificial Sequence
  VH linker of the DVD-Ig, D2-GS6-G9 DVD
GGGGSG

SEQ ID NO: 580 - protein, 124 aa, Artificial Sequence; identical to SEQ ID NO: 40
  VH region of IL-17 antibody G9

SEQ ID NO: 581 - protein, 330 aa, Artificial Sequence [sequence omitted]

SEQ ID NO: 582 - protein, 329 aa, Artificial Sequence [sequence omitted]

SEQ ID NO: 583 - protein, 108 aa, Artificial Sequence; identical to SEQ ID NO: 568
  VL region of TNF antibody D2E7

SEQ ID NO: 584 - protein, 5 aa, Artificial Sequence
  VL linker of the DVD-Ig, E7-GS6-G9 DVD
GGSGG

SEQ ID NO: 585 - protein, 111 aa, Artificial Sequence; identical to SEQ ID NO: 78
  VL region of IL-17 antibody G9

SEQ ID NO: 586 - protein, 106 aa, Artificial Sequence; identical to SEQ ID NO: 5
  CL region of the DVD-Ig, E7-SG6-G9 DVD

SEQ ID NO: 587 - protein, 224 aa, Artificial Sequence
  Dual VL regions of the DVD-Ig, E7-SL-G9 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQTVSISCSGSNSNIGSHSVNWYQQVPGAAPKLLMYGIGQRPSGVPDRFSVSQSGTSASLAISGLQSEDEADYYCATWDDSLGGYVFGSGTKVTVLG

SEQ ID NO: 588 - protein, 108 aa, Artificial Sequence; identical to SEQ ID NO: 568
  VL region of TNF antibody D2E7

SEQ ID NO: 589 - protein, 5 aa, Artificial Sequence
  VL linker of the DVD-Ig, E7-SL-G9 DVD
TVAAP

SEQ ID NO: 590 - protein, 111 aa, Artificial Sequence; identical to SEQ ID NO: 78
  VL region of IL-17 antibody G9

SEQ ID NO: 591 - protein, 106 aa, Artificial Sequence; identical to SEQ ID NO: 5
  CL region of the DVD-Ig, E7-SL-G9 DVD

SEQ ID NO: 592 - protein, 251 aa, Artificial Sequence
  Dual VH regions of the DVD-Ig, D2-SL-G9 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLLESGGGVVQPGRSLRLSCAASGFIFSNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 593 - protein, 121 aa, Artificial Sequence [sequence omitted]

SEQ ID NO: 594 - protein, 6 aa, Artificial Sequence
  VH linker of the DVD-Ig, D2-SL-G9 DVD
ASTKGP

SEQ ID NO: 595 - protein, 124 aa, Artificial Sequence; identical to SEQ ID NO: 40
  VH region of IL-17 antibody G9

SEQ ID NO: 596 - protein, 330 aa, Artificial Sequence [sequence omitted]

SEQ ID NO: 597 - protein, 224 aa, Artificial Sequence
  Dual VL regions of the DVD-Ig, E7-GS6-G9-1
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGQSVLTQPPSASGTPGQTVSISCSGSHSNIGRHPVDWYQQVPGAAPKLLMYYGGYRPSGVPDRFSGSQSGTSASLAISGLQSEDEADYYCATWDDRLVGYVFGSGTKVTVLG

SEQ ID NO: 598 - protein, 108 aa, Artificial Sequence; identical to SEQ ID NO: 568
  VL region of TNF antibody D2E7

SEQ ID NO: 599 - protein, 5 aa, Artificial Sequence
  VL linker of the DVD-Ig, E7-GS6-G9-1 DVD
GGSGG

SEQ ID NO: 600 - protein, 111 aa, Artificial Sequence; identical to SEQ ID NO: 345
  VL region of IL-17 antibody G9-1

SEQ ID NO: 601 - protein, 106 aa, Artificial Sequence; identical to SEQ ID NO: 5
  CL region of the DVD-Ig, E7-GS6-G9-1 DVD

SEQ ID NO: 602 - protein, 224 aa, Artificial Sequence
  Dual VL regions of the DVD-Ig, E7-SL-G9-1 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQTVSISCSGSHSNIGRHPVDWYQQVPGAAPKLLMYYGGYRPSGVPDRFSGSQSGTSASLAISGLQSEDEADYYCATWDDRLVGYVFGSGTKVTVLG

SEQ ID NO: 603 - protein, 108 aa, Artificial Sequence; identical to SEQ ID NO: 568
  VL region of TNF antibody D2E7

SEQ ID NO: 604 - protein, 5 aa, Artificial Sequence
  VL linker of the DVD-Ig, E7-SL-G9-1 DVD
TVAAP

SEQ ID NO: 605 - protein, 111 aa, Artificial Sequence; identical to SEQ ID NO: 345
  VL region of IL-17 antibody G9-1

SEQ ID NO: 606 - protein, 106 aa, Artificial Sequence; identical to SEQ ID NO: 5
  CL region of the DVD-Ig, E7-SL-G9-1 DVD

SEQ ID NO: 607 - protein, 224 aa, Artificial Sequence
  Dual VL regions of the DVD-Ig, E7-GS6-G9-4 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGQSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVFGSGTKVTVLG

SEQ ID NO: 608 - protein, 108 aa, Artificial Sequence; identical to SEQ ID NO: 568
  VL region of TNF antibody D2E7

SEQ ID NO: 609 - protein, 5 aa, Artificial Sequence
  VL linker of the DVD-Ig, E7-GS6-G9-4 DVD
GGSGG

SEQ ID NO: 610 - protein, 111 aa, Artificial Sequence; identical to SEQ ID NO: 348
  VL region of IL-17 antibody G9-4

SEQ ID NO: 611 - protein, 106 aa, Artificial Sequence; identical to SEQ ID NO: 5
  CL region of the DVD-Ig, E7-GS6-G9-4 DVD

SEQ ID NO: 612 - protein, 224 aa, Artificial Sequence
  Dual VL regions of the DVD-Ig, E7-SL-G9-4 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQTVSISCSGRQSNIGRHYVDWYQQVPGAAPKLLMYYDSIRPSGVPDRFSGSQSGTSASLAISGLQSEDEADYYCATWDDSLGGYVFGSGTKVTVLG

SEQ ID NO: 613 - protein, 108 aa, Artificial Sequence; identical to SEQ ID NO: 568
  VL region of TNF antibody D2E7

SEQ ID NO: 614 - protein, 5 aa, Artificial Sequence
  VL linker of the DVD-Ig, E7-SL-G9-4 DVD
TVAAP

SEQ ID NO: 615 - protein, 111 aa, Artificial Sequence; identical to SEQ ID NO: 348
  VH region of IL-17 antibody G9-4

SEQ ID NO: 616 - protein, 106 aa, Artificial Sequence; identical to SEQ ID NO: 5
  CL region of the DVD-Ig, E7-SL-G9-4 DVD

SEQ ID NO: 617 - protein, 224 aa, Artificial Sequence
  Dual VL regions of the DVD-Ig, E7-GS6-G9-M2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGQSVLTQPPSASGTPGQTVSISCSGHNSNIGYHYVHWYQQVPGAAPKLLIYGDGWRPSGVPDRFSGSQSGTSASLAISGLQSEDEADYYCGTWDDWLGGYVFGTGTKVTVLG

SEQ ID NO: 618 - protein, 108 aa, Artificial Sequence; identical to SEQ ID NO: 568
  VL region of TNF antibody D2E7

SEQ ID NO: 619 - protein, 5 aa, Artificial Sequence
  VL linker of the DVD-Ig, E7-GS6-G9-M2 DVD
GGSGG

SEQ ID NO: 620 - protein, 111 aa, Artificial Sequence; identical to SEQ ID NO: 350
  VL region of IL-17 antibody G9-M2

SEQ ID NO: 621 - protein, 106 aa, Artificial Sequence; identical to SEQ ID NO: 5
  CL region of the DVD-Ig, E7-GS6-G9-M2 DVD

SEQ ID NO: 622 - protein, 224 aa, Artificial Sequence
  Dual VL regions of the DVD-Ig, E7-SL-G9-M2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQTVSISCSGHNSNIGYHYVHWYQQVPGAAPKLLIYGDGWRPSGVPDRFSGSQSGTSASLAISGLQSEDEADYYCGTWDDWLGGYVFGTGTKVTVLG

SEQ ID NO: 623 - protein, 108 aa, Artificial Sequence; identical to SEQ ID NO: 568
  VL region of TNF antibody D2E7

SEQ ID NO: 624 - protein, 5 aa, Artificial Sequence
  VL linker of the DVD-Ig, E7-SL-G9-M2 DVD
TVAAP

SEQ ID NO: 625 - protein, 111 aa, Artificial Sequence; identical to SEQ ID NO: 350
  VL region of IL-17 antibody G9-M2

SEQ ID NO: 626 - protein, 106 aa, Artificial Sequence; identical to SEQ ID NO: 5
  CL region of the DVD-Ig, E7-SL-G9-M2 DVD

SEQ ID NO: 627 - protein, 255 aa, Artificial Sequence
  Dual VH regions of the DVD-Ig, D2-GS10-G9-2 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 628 - protein, 121 aa, Artificial Sequence [sequence omitted]

SEQ ID NO: 629 - protein, 10 aa, Artificial Sequence
  VH linker of the DVD-Ig, D2-GS10-G9-2 DVD
GGGGSGGGGS

SEQ ID NO: 630 - protein, 124 aa, Artificial Sequence; identical to SEQ ID NO: 114
  VH region of IL-17 antibody G9-2

SEQ ID NO: 631 - protein, 330 aa, Artificial Sequence [sequence omitted]

SEQ ID NO: 632 - protein, 229 aa, Artificial Sequence
  Dual VL regions of the DVD-Ig, E7-GS10-G9-2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSQSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG

SEQ ID NO: 633 - protein, 108 aa, Artificial Sequence; identical to SEQ ID NO: 568
  VL region of TNF antibody D2E7

SEQ ID NO: 634 - protein, 10 aa, Artificial Sequence
  VL linker of the DVD-Ig, E7-GS10-G9-2 DVD
GGSGGGGSGS

SEQ ID NO: 635 - protein, 111 aa, Artificial Sequence; identical to SEQ ID NO: 352
  VL region of IL-17 antibody G9-2

SEQ ID NO: 636 - protein, 106 aa, Artificial Sequence; identical to SEQ ID NO: 5
  CL region of the DVD-Ig, E7-GS10-G9-2 DVD

SEQ ID NO: 637 - protein, 251 aa, Artificial Sequence
  Dual VH regions of the DVD-Ig, D2-GS6-G9-2 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 638 - protein, 121 aa, Artificial Sequence [sequence omitted]

SEQ ID NO: 639 - protein, 6 aa, Artificial Sequence
  VH linker of the DVD-Ig, D2-GS6-G9-2 DVD
GGGGSG

SEQ ID NO: 640 - protein, 124 aa, Artificial Sequence; identical to SEQ ID NO: 114
  VH region of IL-17 antibody G9-2

SEQ ID NO: 641 - protein, 330 aa, Artificial Sequence [sequence omitted]

SEQ ID NO: 642 - protein, 224 aa, Artificial Sequence
  Dual VL regions of the DVD-Ig, E7-GS6-G9-2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGQSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG

SEQ ID NO: 643 - protein, 108 aa, Artificial Sequence; identical to SEQ ID NO: 568
  VL region of TNF antibody D2E7

SEQ ID NO: 644 - protein, 5 aa, Artificial Sequence
  VL linker of the DVD-Ig, E7-GS6-G9-2 DVD
GGSGG

SEQ ID NO: 645 - protein, 111 aa, Artificial Sequence; identical to SEQ ID NO: 352
  VL region of IL-17 antibody G9-2

SEQ ID NO: 646 - protein, 106 aa, Artificial Sequence; identical to SEQ ID NO: 5
  CL region of the DVD-Ig, E7-GS6-G9-2 DVD

SEQ ID NO: 647 - protein, 259 aa, Artificial Sequence
  Dual VH regions of the DVD-Ig, D2-GS14-G9-2 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGEVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 648 - protein, 121 aa, Artificial Sequence [sequence omitted]

SEQ ID NO: 649 - protein, 14 aa, Artificial Sequence
  VH linker of the DVD-Ig, D2-GS14-G9-2 DVD
GGGGSGGGGSGGGG

SEQ ID NO: 650 - protein, 124 aa, Artificial Sequence; identical to SEQ ID NO: 114
  VH region of IL-17 antibody G9-2

SEQ ID NO: 651 - protein, 330 aa, Artificial Sequence [sequence omitted]

SEQ ID NO: 652 - protein, 232 aa, Artificial Sequence
  Dual VL regions of the DVD-Ig, E7-GS14-G9-2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGGGGSQSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG

SEQ ID NO: 653 - protein, 108 aa, Artificial Sequence; identical to SEQ ID NO: 568
  VL region of TNF antibody D2E7

SEQ ID NO: 654 - protein, 13 aa, Artificial Sequence
  VL linker of the DVD-Ig, E7-GS14-G9-2 DVD
GGSGGGGSGGGGS

SEQ ID NO: 655 - protein, 111 aa, Artificial Sequence; identical to SEQ ID NO: 352
  VL region of IL-17 antibody G9-2

SEQ ID NO: 656 - protein, 106 aa, Artificial Sequence; identical to SEQ ID NO: 5
  CL region of the DVD-Ig, E7-GS14-G9-2 DVD

SEQ ID NO: 657 - protein, 251 aa, Artificial Sequence
  Dual VH regions of the DVD-Ig, D2-SL-G9-2 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLLESGGGVVQPGRSLRLSCAASGFIFRNYGMHWVRQAPGKGLEWVAVISYDGSNKYYADSVKGRFTISRDNSKNTLYLEMNSLRPEDTAVYYCAKVGASGDYYYSYGLDVWGQGTTVTVSS

SEQ ID NO: 658 - protein, 121 aa, Artificial Sequence [sequence omitted]

SEQ ID NO: 659 - protein, 6 aa, Artificial Sequence
  VH linker of the DVD-Ig, D2-SL-G9-2 DVD
ASTKGP

SEQ ID NO: 660 - protein, 124 aa, Artificial Sequence; identical to SEQ ID NO: 114
  VH region of IL-17 antibody G9-2

SEQ ID NO: 661 - protein, 330 aa, Artificial Sequence [sequence omitted]

SEQ ID NO: 662 - protein, 224 aa, Artificial Sequence
  Dual VL regions of the DVD-Ig, E7-SL-G9-2 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQSVLTQPPSASGTPGQTVSISCSGSNSNIGRHPVDWYQQVPGAAPKLLIYYDDQRPSGVPDRFSGSQSGTSASLAISGLQSEDEADYYCATWDDSLGGYVFGSGTKVTVLG

SEQ ID NO: 663 - protein, 108 aa, Artificial Sequence; identical to SEQ ID NO: 568
  VL region of TNF antibody D2E7

SEQ ID NO: 664 - protein, 5 aa, Artificial Sequence
  VL linker of the DVD-Ig, E7-SL-G9-2 DVD
TVAAP

SEQ ID NO: 665 - protein, 111 aa, Artificial Sequence; identical to SEQ ID NO: 352
  VL region of IL-17 antibody G9-2

SEQ ID NO: 666 - protein, 106 aa, Artificial Sequence; identical to SEQ ID NO: 5
  CL region of the DVD-Ig, E7-SL-G9-2 DVD

SEQ ID NO: 667 - protein, 257 aa, Artificial Sequence
  Dual VH regions of the DVD-Ig, D2-GS10-B6-17 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 668 - protein, 121 aa, Artificial Sequence [sequence omitted]

SEQ ID NO: 669 - protein, 10 aa, Artificial Sequence
  VH linker of the DVD-Ig, D2-GS10-B6-17 DVD
GGGGSGGGGS

SEQ ID NO: 670 - protein, 126 aa, Artificial Sequence; identical to SEQ ID NO: 389
  VH region of IL-17 antibody B6-17

SEQ ID NO: 671 - protein, 330 aa, Artificial Sequence [sequence omitted]

SEQ ID NO: 672 - protein, 226 aa, Artificial Sequence
  Dual VL regions of the DVD-Ig, E7-GS10-B6-17 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 673 - protein, 108 aa, Artificial Sequence; identical to SEQ ID NO: 568
  VL region of TNF antibody D2E7

SEQ ID NO: 674 - protein, 10 aa, Artificial Sequence
  VL linker of the DVD-Ig, E7-GS10-B6-17 DVD
GGSGGGGSGS

SEQ ID NO: 675 - protein, 108 aa, Artificial Sequence
  VL region of IL-17 antibody B6-17
EIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 676 - protein, 106 aa, Artificial Sequence; identical to SEQ ID NO: 5
  CL region of the DVD-Ig, E7-GS10-B6-17 DVD

SEQ ID NO: 677 - protein, 253 aa, Artificial Sequence
  Dual VH regions of the DVD-Ig, D2-GS6-B6-17 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 678 - protein, 121 aa, Artificial Sequence [sequence omitted]

SEQ ID NO: 679 - protein, 6 aa, Artificial Sequence
  VH linker of the DVD-Ig, D2-GS6-B6-17 DVD
GGGGSG

SEQ ID NO: 680 - protein, 126 aa, Artificial Sequence; identical to SEQ ID NO: 389
  VH region of IL-17 antibody B6-17

SEQ ID NO: 681 - protein, 330 aa, Artificial Sequence [sequence omitted]

SEQ ID NO: 682 - protein, 221 aa, Artificial Sequence
  Dual VL regions of the DVD-Ig, E7-GS6-B6-17 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 683 - protein, 108 aa, Artificial Sequence; identical to SEQ ID NO: 568
  VL region of TNF antibody D2E7

SEQ ID NO: 684 - protein, 5 aa, Artificial Sequence
  VL linker of the DVD-Ig, E7-SG6-B6-17 DVD
GGSGG

SEQ ID NO: 685 - protein, 108 aa, Artificial Sequence; identical to SEQ ID NO: 675
  VL region of IL-17 antibody B6-17

SEQ ID NO: 686 - protein, 106 aa, Artificial Sequence; identical to SEQ ID NO: 5
  CL region of the DVD-Ig, E7-GS6-B6-17 DVD

SEQ ID NO: 687 - protein, 261 aa, Artificial Sequence
  Dual VH regions of the DVD-Ig, D2-GS14-B6-17 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 688 - protein, 121 aa, Artificial Sequence [sequence omitted]

SEQ ID NO: 689 - protein, 14 aa, Artificial Sequence
  VH linker of the DVD-Ig, D2-GS14-B6-17 DVD
GGGGSGGGGSGGGG

SEQ ID NO: 690 - protein, 126 aa, Artificial Sequence; identical to SEQ ID NO: 389
  VH region of IL-17 antibody B6-17

SEQ ID NO: 691 - protein, 330 aa, Artificial Sequence [sequence omitted]

SEQ ID NO: 692 - protein, 229 aa, Artificial Sequence
  Dual VL regions of the DVD-Ig, E7-GS14-B6-17 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGGGGSEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 693 - protein, 108 aa, Artificial Sequence; identical to SEQ ID NO: 568
  VL region of TNF antibody D2E7

SEQ ID NO: 694 - protein, 13 aa, Artificial Sequence
  CL region of the DVD-Ig, E7-GS14-B6-17 DVD
GGSGGGGSGGGGS

SEQ ID NO: 695 - protein, 108 aa, Artificial Sequence; identical to SEQ ID NO: 675
  VL region of IL-17 antibody B6-17

SEQ ID NO: 696 - protein, 106 aa, Artificial Sequence; identical to SEQ ID NO: 5
  CL region of the DVD-Ig, E7-GS14-B6-17 DVD

SEQ ID NO: 697 - protein, 253 aa, Artificial Sequence
  Dual VH regions of the DVD-Ig, D2-SL-B6-17 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 698 - protein, 121 aa, Artificial Sequence [sequence omitted]

SEQ ID NO: 699 - protein, 6 aa, Artificial Sequence
  VL linker of the DVD-Ig, D2-SL-B6-17 DVD
ASTKGP

SEQ ID NO: 700 - protein, 126 aa, Artificial Sequence; identical to SEQ ID NO: 389
  VH region of IL-17 antibody B6-17

SEQ ID NO: 701 - protein, 330 aa, Artificial Sequence [sequence omitted]

SEQ ID NO: 702 - protein, 221 aa, Artificial Sequence
  Dual VL regions of the DVD-Ig, E7-SL-B6-17 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 703 - protein, 108 aa, Artificial Sequence; identical to SEQ ID NO: 568
  VL region of TNF antibody D2E7

SEQ ID NO: 704 - protein, 5 aa, Artificial Sequence
  VL linker of the DVD-Ig, E7-SL-B6-17 DVD
TVAAP

SEQ ID NO: 705 - protein, 108 aa, Artificial Sequence; identical to SEQ ID NO: 675
  VL region of IL-17 antibody B6-17

SEQ ID NO: 706 - protein, 106 aa, Artificial Sequence; identical to SEQ ID NO: 5
  CL region of the DVD-Ig, E7-SL-B6-17 DVD

SEQ ID NO: 707 - protein, 260 aa, Artificial Sequence
  Dual VH regions of the DVD-Ig, D2-LL-B6-17 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSS

SEQ ID NO: 708 - protein, 121 aa, Artificial Sequence [sequence omitted]

SEQ ID NO: 709 - protein, 13 aa, Artificial Sequence
  VH linker of the DVD-Ig, D2-LL-B6-17 DVD
ASTKGPSVFPLAP

SEQ ID NO: 710 - protein, 126 aa, Artificial Sequence; identical to SEQ ID NO: 389
  VH region of IL-17 antibody B6-17

SEQ ID NO: 711 - protein, 330 aa, Artificial Sequence [sequence omitted]

SEQ ID NO: 712 - protein, 228 aa, Artificial Sequence
  Dual VL regions of the DVD-Ig, E7-LL-B6-17 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKR

SEQ ID NO: 713 - protein, 108 aa, Artificial Sequence; identical to SEQ ID NO: 568
  VL region of TNF antibody D2E7

SEQ ID NO: 714 - protein, 12 aa, Artificial Sequence
  VL linker of the DVD-Ig, E7-LL-B6-17 DVD
TVAAPSVFIFPP

SEQ ID NO: 715 - protein, 108 aa, Artificial Sequence; identical to SEQ ID NO: 675
  VL region of IL-17 antibody B6-17

SEQ ID NO: 716 - protein, 106 aa, Artificial Sequence; identical to SEQ ID NO: 5
  CL region of the DVD-Ig, E7-LL-B6-17 DVD

SEQ ID NO: 717 - protein, 257 aa, Artificial Sequence
  Dual VH regions of the DVD-Ig, D2-GS10-B6-5 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 718 - protein, 121 aa, Artificial Sequence [sequence omitted]

SEQ ID NO: 719 - protein, 10 aa, Artificial Sequence
  VH linker of the DVD-Ig, D2-GS10-B6-5 DVD
GGGGSGGGGS

SEQ ID NO: 720 - protein, 126 aa, Artificial Sequence; identical to SEQ ID NO: 403
  VH region of IL-17 antibody B6-5

SEQ ID NO: 721 - protein, 330 aa, Artificial Sequence [sequence omitted]

SEQ ID NO: 722 - protein, 226 aa, Artificial Sequence
  Dual VL regions of the DVD-Ig, E7-GS10-B6-5 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 723 - protein, 108 aa, Artificial Sequence; identical to SEQ ID NO: 568
  VL region of TNF antibody D2E7

SEQ ID NO: 724 - protein, 10 aa, Artificial Sequence
  VL linker of the DVD-Ig, E7-GS10-B6-5 DVD
GGSGGGGSGS

SEQ ID NO: 725 - protein, 108 aa, Artificial Sequence
  VL region of IL-17 antibody B6-5
EIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 726 - protein, 106 aa, Artificial Sequence; identical to SEQ ID NO: 5
  CL region of the DVD-Ig, E7-GS10-B6-5 DVD

SEQ ID NO: 727 - protein, 253 aa, Artificial Sequence
  Dual VH regions of the DVD-Ig, D2-GS6-B6-5 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGESVKISCKASGGSFRSYGISWVRQAPGQGLEWMGGITHFFGITDYAQKFQGRVTITADESTTTAYMELSGLTSDDTAVYYCAREPNDFWNGYYDTHDFDSWGQGTTVTVSS

SEQ ID NO: 728 - protein, 121 aa, Artificial Sequence [sequence omitted]

SEQ ID NO: 729 - protein, 6 aa, Artificial Sequence
  VH linker of the DVD-Ig, D2-GS6-B6-5 DVD
GGGGSG

SEQ ID NO: 730 - protein, 126 aa, Artificial Sequence; identical to SEQ ID NO: 403
  VH region of IL-17 antibody B6-5

SEQ ID NO: 731 - protein, 330 aa, Artificial Sequence [sequence omitted]

SEQ ID NO: 732 - protein, 221 aa, Artificial Sequence
  Dual VL regions of the DVD-Ig, E7-SL-B6-5 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPEIVLTQSPDFQSVTPKEKVTITCRASQNIGSELHWYQQKPDQSPKLLIKYASHSISGVPSRFSGSGSGTDFTLTINGLEAEDAATYYCHQSDTLPHTFGQGTKVDIKR

SEQ ID NO: 733 - protein, 108 aa, Artificial Sequence; identical to SEQ ID NO: 568
  VL region of TNF antibody D2E7

SEQ ID NO: 734 - protein, 5 aa, Artificial Sequence
  CL region of the DVD-Ig, E7-SL-B6-5 DVD
TVAAP

SEQ ID NO: 735 - protein, 108 aa, Artificial Sequence; identical to SEQ ID NO: 725
  VL region of IL-17 antibody B6-5

SEQ ID NO: 736 - protein, 106 aa, Artificial Sequence; identical to SEQ ID NO: 5
  CL region of the DVD-Ig, E7-SL-B6-5 DVD

SEQ ID NO: 737 - protein, 253 aa, Artificial Sequence
  Dual VH regions of the DVD-Ig, D2-SL-B6-15 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPEVQLVQSGAEVKKPGESLKISCKASGGSFSGYGTSWVRQAPGQGLEWMGGITHFFGAVDYAQKFQGRVTITADESTTTAYMELSGLTSDDTAVYYCARDPNEFWNGYYATHDFDYWGQGTTVTVSS

SEQ ID NO: 738 - protein, 121 aa, Artificial Sequence [sequence omitted]

SEQ ID NO: 739 - protein, 6 aa, Artificial Sequence
  VH linker of the DVD-Ig, D2-SL-B6-15 DVD
ASTKGP

SEQ ID NO: 740 - protein, 126 aa, Artificial Sequence; identical to SEQ ID NO: 383
  VH region of IL-17 antibody B6-15

SEQ ID NO: 741 - protein, 330 aa, Artificial Sequence [sequence omitted]

SEQ ID NO: 742 - protein, 221 aa, Artificial Sequence
  Dual VL regions of the DVD-Ig, E7-GS6-B6-15 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIKR

SEQ ID NO: 743 - protein, 108 aa, Artificial Sequence; identical to SEQ ID NO: 568
  VL region of TNF antibody D2E7

SEQ ID NO: 744 - protein, 5 aa, Artificial Sequence
  VL linker of the DVD-Ig, D2-GS6-B6-15 DVD
GGSGG

SEQ ID NO: 745 - protein, 108 aa, Artificial Sequence
  VL region of IL-17 antibody B6-15
EIVLTQSPDFQSVTPKEKVTITCRASQNIGAELHWYQQKPDQSPKLLIKYASHSISGVPSRFSGSGSGTDFTLTINGLEAEDAGTYYCHQTDRLPYSFGPGTKVDIKR

SEQ ID NO: 746 - protein, 106 aa, Artificial Sequence; identical to SEQ ID NO: 5
  CL region of the DVD-Ig, E7-GS6-B6-15 DVD

SEQ ID NO: 747 - protein, 250 aa, Artificial Sequence
  Dual VH regions of the DVD-Ig, D2-GS10-h5C5Vh1  DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGASVKVSCKASGYTFTDYEFHWVRQAPGQGLEWMGVIHPGNGGTAYNQNFRDRVTITADKSTSTAYMELSSLRSEDTAVYYCARFLTYEGYFDYWGQGTLVTVSS

SEQ ID NO: 748 - protein, 121 aa, Artificial Sequence [sequence omitted]

SEQ ID NO: 749 - protein, 10 aa, Artificial Sequence
  VH linker of the DVD-Ig, D2-GS10-h5C5Vh1 DVD
GGGGSGGGGS

SEQ ID NO: 750 - protein, 119 aa, Artificial Sequence; identical to SEQ ID NO: 69
  VH region of IL-17 antibody h5C5Vh1

SEQ ID NO: 751 - protein, 330 aa, Artificial Sequence [sequence omitted]

SEQ ID NO: 752 - protein, 226 aa, Artificial Sequence
  Dual VL regions of the DVD-Ig, E7-GS10-h5C5Vk3a
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSEIVMTQSPATLSVSPGERATLSCKASQSVSIDVGWFQQKPGQSPRLLIYHASNRYTGVPARFSGSGSGTDFTLTISSLQPEDFAVYFCQQDYSSPYTFGQGTKLEIKR

SEQ ID NO: 753 - protein, 108 aa, Artificial Sequence; identical to SEQ ID NO: 568
  VL region of TNF antibody D2E7

SEQ ID NO: 754 - protein, 10 aa, Artificial Sequence
  VL linker of the DVD-Ig, E7-GS10-h5C5Vk3a DVD
GGSGGGGSGS

SEQ ID NO: 755 - protein, 108 aa, Artificial Sequence; identical to SEQ ID NO: 75
  VL region of IL-17 antibody H5C5 Vk3a

SEQ ID NO: 756 - protein, 106 aa, Artificial Sequence; identical to SEQ ID NO: 5
  CL region of the DVD-Ig, E7-GS10-h5C5Vk3a DVD

SEQ ID NO: 757 - protein, 250 aa, Artificial Sequence
  Dual VH regions of the DVD-Ig, D2-GS10-6C6  DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSQVQLQQSGAELVRPGASVKLSCKASGYTFSDYEIHWVKQTPVHGLAWIGVIHPGNGGTAYNQKFKDKATLTADKSSSTAYMELSSLTSEDSAVYYCERFLTYEGYFDYWGQGTTLTVSS

SEQ ID NO: 758 - protein, 121 aa, Artificial Sequence [sequence omitted]

SEQ ID NO: 759 - protein, 10 aa, Artificial Sequence
  VH linker of the DVD-Ig, D2-GS10-6C6 DVD
GGGGSGGGGS

SEQ ID NO: 760 - protein, 119 aa, Artificial Sequence; identical to SEQ ID NO: 28
  VH region of IL-17 antibody 6C6

SEQ ID NO: 761 - protein, 330 aa, Artificial Sequence [sequence omitted]

SEQ ID NO: 762 - protein, 252 aa, Artificial Sequence
  Dual VH regions of the DVD-Ig, D2-GS10-h10F7Vh1a  DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGSSVKVSCKASGYTFTDYEIHWVRQAPGQGLEWMGVNDPESGGTFYNQKFDGRVTITADKSTSTAYMELSSLRSEDTAVYYCARYYRYESFYGMDYWGQGTTVTVSS

SEQ ID NO: 763 - protein, 121 aa, Artificial Sequence [sequence omitted]

SEQ ID NO: 764 - protein, 10 aa, Artificial Sequence
  VH linker of the DVD-Ig, D2-GS10-h10F7Vh1a DVD
GGGGSGGGGS

SEQ ID NO: 765 - protein, 121 aa, Artificial Sequence; identical to SEQ ID NO: 60
  VH region of IL-17 antibody h10F7Vh1a

SEQ ID NO: 766 - protein, 330 aa, Artificial Sequence [sequence omitted]

SEQ ID NO: 767 - protein, 225 aa, Artificial Sequence
  Dual VL regions of the DVD-Ig, E7-GS10-h10F7Vk1a DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSDIQLTQSPSSLSASVGDRVTITCSASSSISYIYWFQQKPGKSPKRWIYATFELASGVPSRFSGSGSGTDYTLTISSLQPEDFATYYCHQRSSYPWTFGQGTKLEIKR

SEQ ID NO: 768 - protein, 108 aa, Artificial Sequence; identical to SEQ ID NO: 568
  VL region of TNF antibody D2E7

SEQ ID NO: 769 - protein, 10 aa, Artificial Sequence
  VL linker of the DVD-Ig, E7-GS10-h10F7Vk1a DVD
GGSGGGGSGS

SEQ ID NO: 770 - protein, 107 aa, Artificial Sequence; identical to SEQ ID NO: 63
  VH region of IL-17 antibody h10F7Vk1a

SEQ ID NO: 771 - protein, 106 aa, Artificial Sequence; identical to SEQ ID NO: 5
  CL region of the DVD-Ig, E7-GS10-h10F7Vk1a

SEQ ID NO: 772 - protein, 246 aa, Artificial Sequence
  Dual VH regions of the DVD-Ig, D2-GS6-h5C5Vh1 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGASVKVSCKASGYTFTDYEFHWVRQAPGQGLEWMGVIHPGNGGTAYNQNFRDRVTITADKSTSTAYMELSSLRSEDTAVYYCARFLTYEGYFDYWGQGTLVTVSS

SEQ ID NO: 773 - protein, 121 aa, Artificial Sequence [sequence omitted]

SEQ ID NO: 774 - protein, 6 aa, Artificial Sequence
  VH linker of the DVD-Ig, D2-GS6-h5C5Vh1 DVD
GGGGSG

SEQ ID NO: 775 - protein, 119 aa, Artificial Sequence; identical to SEQ ID NO: 69
  VH region of IL-17 antibody h5C5Vh1

SEQ ID NO: 776 - protein, 330 aa, Artificial Sequence [sequence omitted]

SEQ ID NO: 777 - protein, 221 aa, Artificial Sequence
  Dual VL regions of the DVD-Ig, E7-SL-h5C5Vk1a DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPDIQMTQSPSSLSASVGDRVTITCKASQSVSIDVGWFQQKPGKSPKLLIYHASNRYTGVPSRFSGSGSGTDFTFTISSLQPEDFATYFCQQDYSSPYTFGQGTKLEIKR

SEQ ID NO: 778 - protein, 108 aa, Artificial Sequence; identical to SEQ ID NO: 568
  VL region of TNF antibody D2E7

SEQ ID NO: 779 - protein, 5 aa, Artificial Sequence
  VL linker of the DVD-Ig, E7-SL-h5C5Vk1a DVD
TVAAP

SEQ ID NO: 780 - protein, 108 aa, Artificial Sequence; identical to SEQ ID NO: 72
  VL region of IL-17 antibody h5C5-Vk1a

SEQ ID NO: 781 - protein, 106 aa, Artificial Sequence; identical to SEQ ID NO: 5
  CL region of the DVD-Ig, E7-SL-h5C5Vk1a DVD

SEQ ID NO: 782 - protein, 246 aa, Artificial Sequence
  Dual VH regions of the DVD-Ig, D2-GS6-h5C5Vh1b  DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKKPGASVKVSCKASGYTFTDYEFHWVRQAPGQGLEWIGVIHPGNGGTAYNQNFRDRATLTADKSTSTAYMELSSLRSEDTAVYYCTRFLTYEGYFDYWGQGTLVTVSS

SEQ ID NO: 783 - protein, 121 aa, Artificial Sequence [sequence omitted]

SEQ ID NO: 784 - protein, 6 aa, Artificial Sequence
  VL linker of the DVD-Ig, D2-GS6-h5C5Vh1b DVD
GGGGSG

SEQ ID NO: 785 - protein, 119 aa, Artificial Sequence
  VH region of IL-17 antibody h5C5Vh1b
EVQLVQSGAEVKKPGASVKVSCKASGYTFTDYEFHWVRQAPGQGLEWIGVIHPGNGGTAYNQNFRDRATLTADKSTSTAYMELSSLRSEDTAVYYCTRFLTYEGYFDYWGQGTLVTVSS

SEQ ID NO: 786 - protein, 330 aa, Artificial Sequence [sequence omitted]

SEQ ID NO: 787 - protein, 221 aa, Artificial Sequence
  Dual VL regions of the DVD-Ig, E7-SL-h5C5Vk3a DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPEIVMTQSPATLSVSPGERATLSCKASQSVSIDVGWFQQKPGQSPRLLIYHASNRYTGVPARFSGSGSGTDFTLTISSLQPEDFAVYFCQQDYSSPYTFGQGTKLEIKR

SEQ ID NO: 788 - protein, 108 aa, Artificial Sequence; identical to SEQ ID NO: 568
  VL region of TNF antibody D2E7

SEQ ID NO: 789 - protein, 5 aa, Artificial Sequence
  VL linker of the DVD-Ig, E7-SL-h5C5Vk3a DVD
TVAAP

SEQ ID NO: 790 - protein, 108 aa, Artificial Sequence; identical to SEQ ID NO: 75
  VL region of IL-17 antibody h5C5Vk3a

SEQ ID NO: 791 - protein, 106 aa, Artificial Sequence; identical to SEQ ID NO: 5
  CL region of the DVD-Ig, E7-SL-h5C5Vk3a DVD

SEQ ID NO: 792 - protein, 248 aa, Artificial Sequence
  Dual VH regions of the DVD-Ig, D2-GS6-10F7 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGQVQLQQSGAELVRPGTSVTLSCKASGYIFTDYEIHWVKQTPVHGLEWIGVNDPESGGTFYNQKFDGKAELTADKSSSTAYMELRSLTSEDSGVYYCTRYYRYESFYGMDYWGQGTSITVSS

SEQ ID NO: 793 - protein, 121 aa, Artificial Sequence [sequence omitted]

SEQ ID NO: 794 - protein, 6 aa, Artificial Sequence
  VH linker of the DVD-Ig, D2-GS6-10F7 DVD
GGGGSG

SEQ ID NO: 795 - protein, 121 aa, Artificial Sequence; identical to SEQ ID NO: 34
  VH region of IL-17 antibody 10F7

SEQ ID NO: 796 - protein, 330 aa, Artificial Sequence [sequence omitted]

SEQ ID NO: 797 - protein, 220 aa, Artificial Sequence
  Dual VL regions of the DVD-Ig, E7-SL-10F7 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPQIVLTQSPAIMSASPGEKVTMTCSASSSISYIYWFQQKPGTSPKRWIYATFELASGVPARFSGSGSGTSYSLTISSMEAEDAATYYCHQRSSYPWTFGGGSKLEIKR

SEQ ID NO: 798 - protein, 108 aa, Artificial Sequence; identical to SEQ ID NO: 568
  VL region of TNF antibody D2E7

SEQ ID NO: 799 - protein, 5 aa, Artificial Sequence
  VL linker of the DVD-Ig, E7-SL-10F7 DVD
TVAAP

SEQ ID NO: 800 - protein, 107 aa, Artificial Sequence; identical to SEQ ID NO: 35
  VL region of IL-17 antibody 10F7

SEQ ID NO: 801 - protein, 106 aa, Artificial Sequence; identical to SEQ ID NO: 5
  CL region of the DVD-Ig, E7-SL-10F7 DVD

SEQ ID NO: 802 - protein, 246 aa, Artificial Sequence
  Dual VH regions of the DVD-Ig, D2-GS6-5C5 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGQVQLQQSGAELVRPGASVKLSCKALGYTFTDYEFHWVKQTPVHGLEWIGVIHPGNGGTAYNQNFRDKATLTADKSSSTAYMELSSLTSEDSGVYYCTRFLTYEGYFDYWGQGTALTVSS

SEQ ID NO: 803 - protein, 121 aa, Artificial Sequence [sequence omitted]

SEQ ID NO: 804 - protein, 6 aa, Artificial Sequence
  VH linker of the DVD-Ig, D2-GS6-5C5 DVD
GGGGSG

SEQ ID NO: 805 - protein, 119 aa, Artificial Sequence; identical to SEQ ID NO: 36
  VH region of IL-17 antibody 5C5

SEQ ID NO: 806 - protein, 330 aa, Artificial Sequence [sequence omitted]

SEQ ID NO: 807 - protein, 221 aa, Artificial Sequence
  Dual VL regions of the DVD-Ig, E7-SL-5C5 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPNIVMTQTPKFLLVSPGDRVTITCKASQSVSIDVGWFQQKPGQSPKLLIYHASNRYTGVPDRFTGSGYGTDFTFTVNTVQAEDLAVYFCQQDYSSPYTFGGGTKLELKR

SEQ ID NO: 808 - protein, 108 aa, Artificial Sequence; identical to SEQ ID NO: 568
  VL region of TNF antibody D2E7

SEQ ID NO: 809 - protein, 5 aa, Artificial Sequence
  VL linker of the DVD-Ig, E7-SL-5C5 DVD
TVAAP

SEQ ID NO: 810 - protein, 108 aa, Artificial Sequence; identical to SEQ ID NO: 37
  VL region of IL-17 antibody 5C5

SEQ ID NO: 811 - protein, 106 aa, Artificial Sequence; identical to SEQ ID NO: 5
  CL region of the DVD-Ig, E7-SL-5C5 DVD

SEQ ID NO: 812 - protein, 246 aa, Artificial Sequence
  Dual VH regions of the DVD-Ig, D2-GS6-1D8 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGQVQLQQSGAELVRPGASVKLSCKASGYTFSDYEMHWVKQTPVHGLEWIGVIHPGNGGTAYNQKFRDKATLTADKSSTTAYMELSSLTSEDSAVYYCIRFLTYEGYFDYWGQGTTLTVSS

SEQ ID NO: 813 - protein, 121 aa, Artificial Sequence [sequence omitted]

SEQ ID NO: 814 - protein, 6 aa, Artificial Sequence
  VH linker of the DVD-Ig, D2-GS6-1D8  DVD
GGGGSG

SEQ ID NO: 815 - protein, 119 aa, Artificial Sequence; identical to SEQ ID NO: 30
  VH region of IL-17 antibody 1DH

SEQ ID NO: 816 - protein, 330 aa, Artificial Sequence [sequence omitted]

SEQ ID NO: 817 - protein, 221 aa, Artificial Sequence
  Dual VL regions of the DVD-Ig, E7-SL-1D8 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSIVMTQTPKFLLVSAGDRVTITCKASQSVNNDVAWFQHKPGQSPKLLINYASNRYTGVPDRFTGSGYGTDFTFTISTVQSEDLAIYFCQQDYGSPYTFGGGTTLEIKR

SEQ ID NO: 818 - protein, 108 aa, Artificial Sequence; identical to SEQ ID NO: 568
  VL region of TNF antibody D2E7

SEQ ID NO: 819 - protein, 5 aa, Artificial Sequence
  VL linker of the DVD-Ig, E7-SL-1D8 DVD
TVAAP

SEQ ID NO: 820 - protein, 108 aa, Artificial Sequence; identical to SEQ ID NO: 31
  VL region of IL-17 antibody 1D8

SEQ ID NO: 821 - protein, 106 aa, Artificial Sequence; identical to SEQ ID NO: 5
  CL region of the DVD-Ig, E7-SL-1D8 DVD

SEQ ID NO: 822 - protein, 246 aa, Artificial Sequence
  Dual VH regions of the DVD-Ig, D2-GS6-6C6 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGQVQLQQSGAELVRPGASVKLSCKASGYTFSDYEIHWVKQTPVHGLAWIGVIHPGNGGTAYNQKFKDKATLTADKSSSTAYMELSSLTSEDSAVYYCERFLTYEGYFDYWGQGTTLTVSS

SEQ ID NO: 823 - protein, 121 aa, Artificial Sequence [sequence omitted]

SEQ ID NO: 824 - protein, 6 aa, Artificial Sequence
  VH linker of the DVD-Ig, D2-GS6-6C6 DVD
GGGGSG

SEQ ID NO: 825 - protein, 119 aa, Artificial Sequence; identical to SEQ ID NO: 28
  VH region of IL-17 antibody 6C6

SEQ ID NO: 826 - protein, 330 aa, Artificial Sequence [sequence omitted]

SEQ ID NO: 827 - protein, 221 aa, Artificial Sequence
  Dual VL regions of the DVD-Ig, E7-SL-6C6 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSIVMTQTPKFLLVSAGDRVTITCKASQSVNNDVAWYQHKPGQSPKLLINYASNRYTGVPDRFTGSGYGTDFTFTISTVQAEDLAIYFCQQDYGSPYTFGGGTKLEIKR

SEQ ID NO: 828 - protein, 108 aa, Artificial Sequence; identical to SEQ ID NO: 568
  VL region of TNF antibody D2E7

SEQ ID NO: 829 - protein, 5 aa, Artificial Sequence
  VL linker of the DVD-Ig, E7-SL-6C6 DVD
TVAAP

SEQ ID NO: 830 - protein, 108 aa, Artificial Sequence; identical to SEQ ID NO: 29
  VH region of IL-17 antibody 6C6

SEQ ID NO: 831 - protein, 106 aa, Artificial Sequence; identical to SEQ ID NO: 5
  CL region of the DVD-Ig, E7-SL-6C6 DVD

SEQ ID NO: 832 - protein, 247 aa, Artificial Sequence
  Dual VH regions of DVD-Ig, D2-GS6-8B12 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGQVQLKESGPGLVAPSQSLSITCTISGFSLTSYGVHWVRQPPGKGLEWLVVIWSDGTTTYNSALKSRLSITRDNSKSQVFLKMNSLQTDDTAIYYCARDSTWDYYYTMDYWGQGTPVTVSS

SEQ ID NO: 833 - protein, 121 aa, Artificial Sequence [sequence omitted]

SEQ ID NO: 834 - protein, 6 aa, Artificial Sequence
  VH linker of DVD-Ig, D2-GS6-8B12 DVD
GGGGSG

SEQ ID NO: 835 - protein, 120 aa, Artificial Sequence; identical to SEQ ID NO: 32
  VH region of IL-17 antibody 8B12

SEQ ID NO: 836 - protein, 330 aa, Artificial Sequence [sequence omitted]

SEQ ID NO: 837 - protein, 225 aa, Artificial Sequence
  Dual VL regions of DVD-Ig, E7-SL-8B12 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVYTFGGGTKLEIKR

SEQ ID NO: 838 - protein, 108 aa, Artificial Sequence; identical to SEQ ID NO: 568
  VL region of TNF antibody D2E7

SEQ ID NO: 839 - protein, 5 aa, Artificial Sequence
  VL linker of DVD-Ig, E7-SL-8B12 DVD
TVAAP

SEQ ID NO: 840 - protein, 112 aa, Artificial Sequence; identical to SEQ ID NO: 33
  VL region of IL-17 antibody 8B12

SEQ ID NO: 841 - protein, 106 aa, Artificial Sequence; identical to SEQ ID NO: 5
  CL region of the DVD-Ig, E7-SL-8B12 DVD

SEQ ID NO: 842 - protein, 257 aa, Artificial Sequence
  Dual VH regions of DVD-Ig, D2-GS10-B6-11 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGSSVKVSCKASGGSFLSYGFSWVRQAPGQGLEWMGGITPFFGFADYAQKFQGRVTITADESTTTAYMELSGLTSDDTAVYYCAREPNDFWNGYYTTHHFDYWGQGTTVTVSS

SEQ ID NO: 843 - protein, 121 aa, Artificial Sequence [sequence omitted]

SEQ ID NO: 844 - protein, 10 aa, Artificial Sequence
  VH linker of DVD-Ig, D2-GS10-B6-11  DVD
GGGGSGGGGS

SEQ ID NO: 845 - protein, 126 aa, Artificial Sequence; identical to SEQ ID NO: 455
  VH region of IL-17 antibody B6-11

SEQ ID NO: 846 - protein, 330 aa, Artificial Sequence [sequence omitted]

SEQ ID NO: 847 - protein, 226 aa, Artificial Sequence
  Dual VL regions of DVD-Ig, E7-GS10-B6.1 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGSEIVLTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKVDIKR

SEQ ID NO: 848 - protein, 108 aa, Artificial Sequence; identical to SEQ ID NO: 568
  VL region of TNF antibody D2E7

SEQ ID NO: 849 - protein, 10 aa, Artificial Sequence
  VL linker for DVD-Ig, E7-GS10-B6.1 DVD
GGSGGGGSGS

SEQ ID NO: 850 - protein, 108 aa, Artificial Sequence
  VL region of IL-17 antibody B6.1
EIVLTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKVDIKR

SEQ ID NO: 851 - protein, 106 aa, Artificial Sequence; identical to SEQ ID NO: 5
  CL region of the DVD-Ig, E7-GS10-B6.1 DVD

SEQ ID NO: 852 - protein, 260 aa, Artificial Sequence
  Dual VH regions of DVD-Ig, D2-LL-B6-11 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPEVQLVQSGAEVKKPGSSVKVSCKASGGSFLSYGFSWVRQAPGQGLEWMGGITPFFGFADYAQKFQGRVTITADESTTTAYMELSGLTSDDTAVYYCAREPNDFWNGYYTTHHFDYWGQGTTVTVSS

SEQ ID NO: 853 - protein, 121 aa, Artificial Sequence [sequence omitted]

SEQ ID NO: 854 - protein, 13 aa, Artificial Sequence
  VH linker of DVD-Ig, D2-LL-B6-11 DVD
ASTKGPSVFPLAP

SEQ ID NO: 855 - protein, 126 aa, Artificial Sequence; identical to SEQ ID NO: 455
  VH region of IL-17 antibody B6-11

SEQ ID NO: 856 - protein, 330 aa, Artificial Sequence [sequence omitted]

SEQ ID NO: 857 - protein, 228 aa, Artificial Sequence
  Dual VL regions of DVD-Ig, E7-LL-B6.1 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPEIVLTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKVDIKR

SEQ ID NO: 858 - protein, 108 aa, Artificial Sequence; identical to SEQ ID NO: 568
  VL region of TNF antibody D2E7

SEQ ID NO: 859 - protein, 12 aa, Artificial Sequence
  VL linker of DVD-Ig, E7-LL-B6.1 DVD
TVAAPSVFIFPP

SEQ ID NO: 860 - protein, 108 aa, Artificial Sequence; identical to SEQ ID NO: 850
  VL region of IL-17 antibody B6.1

SEQ ID NO: 861 - protein, 106 aa, Artificial Sequence; identical to SEQ ID NO: 5
  CL region of the DVD-Ig, E7-LL-B6.1 DVD

SEQ ID NO: 862 - protein, 252 aa, Artificial Sequence
  Dual VH regions of DVD-Ig, D2-SL-B6-11 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPEVQLVQSGAEVKKPGSSVKVSCKASGGSFLSYGFSWVRQAPGQGLEWMGGITPFFGFADYAQKFQGRVTITADESTTTAYMELSGLTSDDTAVYYCAREPNDFWNGYYTTHHFDYWGQGTTVTVSS

SEQ ID NO: 863 - protein, 121 aa, Artificial Sequence [sequence omitted]

SEQ ID NO: 864 - protein, 5 aa, Artificial Sequence
  VH linker of DVD-Ig, D2-SL-B6-11 DVD
TVAAP

SEQ ID NO: 865 - protein, 126 aa, Artificial Sequence; identical to SEQ ID NO: 455
  VH region of IL-17 antibody B6-11

SEQ ID NO: 866 - protein, 330 aa, Artificial Sequence [sequence omitted]

SEQ ID NO: 867 - protein, 221 aa, Artificial Sequence
  Dual VL regions of DVD-Ig, E7-GS6-B6.1 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQNIGSALHWYQQKPDQSPKLLIKYASQSISGVPSRFSGSGSGTDFTLTINGLEAEDAGTYYCHQSTSLPHTFGQGTKVDIKR

SEQ ID NO: 868 - protein, 108 aa, Artificial Sequence; identical to SEQ ID NO: 568
  VL region of TNF antibody D2E7

SEQ ID NO: 869 - protein, 5 aa, Artificial Sequence
  VL linker of DVD-Ig, E7-GS6-B6.1 DVD
GGSGG

SEQ ID NO: 870 - protein, 108 aa, Artificial Sequence; identical to SEQ ID NO: 850
  VL region of IL-17 antibody B6.1

SEQ ID NO: 871 - protein, 106 aa, Artificial Sequence; identical to SEQ ID NO: 5
  CL region of the DVD-Ig, E7-GS6-B6.1 DVD

SEQ ID NO: 872 - protein, 252 aa, Artificial Sequence
  Dual VH regions of DVD-Ig, D2-SL-B6-16DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPEVQLVQSGAEVKMPGSSLKISCKASGGSFRGYGISWVRQAPGQGLEWMGGITPFFGWADYAQKFQGRVTITADESTTTAYMELSGLTSDDTAVYYCARDPNEFWNGYYDTHHFDYWGQGTTVTVSS

SEQ ID NO: 873 - protein, 121 aa, Artificial Sequence [sequence omitted]

SEQ ID NO: 874 - protein, 5 aa, Artificial Sequence
  VH linker of DVD-Ig, D2-SL-B6-16DVD
TVAAP

SEQ ID NO: 875 - protein, 126 aa, Artificial Sequence; identical to SEQ ID NO: 368
  VH region of IL-17 antibody B6-16

SEQ ID NO: 876 - protein, 330 aa, Artificial Sequence [sequence omitted]

SEQ ID NO: 877 - protein, 221 aa, Artificial Sequence
  Dual VL regions of DVD-Ig, E7-GS6-B6-16 DVD
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGEIVLTQSPDFQSVTPKEKVTITCRASQDIGSALHWYQQKPDQSPKLLIKYASHSVSGVPSRFSGSGSGTDFTLTINGLEAEDAGTYYCHQSDILPHTFGPGTKVDIKR

SEQ ID NO: 878 - protein, 108 aa, Artificial Sequence; identical to SEQ ID NO: 568
  VL region of TNF antibody D2E7

SEQ ID NO: 879 - protein, 5 aa, Artificial Sequence
  VL linker of DVD-Ig, E7-GS6-B6-16 DVD
GGSGG

SEQ ID NO: 880 - protein, 108 aa, Artificial Sequence
  VL region of IL-17 antibody B6-16
EIVLTQSPDFQSVTPKEKVTITCRASQDIGSALHWYQQKPDQSPKLLIKYASHSVSGVPSRFSGSGSGTDFTLTINGLEAEDAGTYYCHQSDILPHTFGPGTKVDIKR

SEQ ID NO: 881 - protein, 106 aa, Artificial Sequence; identical to SEQ ID NO: 5
  CL region of the DVD-Ig, E7-GS6-B6-16 DVD

SEQ ID NO: 882 - protein, 253 aa, Artificial Sequence
  Dual VH regions of DVD-Ig, D2-GS6-B6-16 DVD
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGEVQLVQSGAEVKMPGSSLKISCKASGGSFRGYGISWVRQAPGQGLEWMGGITPFFGWADYAQKFQGRVTITADESTTTAYMELSGLTSDDTAVYYCARDPNEFWNGYYDTHHFDYWGQGTTVTVSS

SEQ ID NO: 883 - protein, 121 aa, Artificial Sequence [sequence omitted]

SEQ ID NO: 884 - protein, 6 aa, Artificial Sequence
  VH linker of DVD-Ig, D2-GS6-B6-16DVD
GGGGSG

SEQ ID NO: 885 - protein, 126 aa, Artificial Sequence; identical to SEQ ID NO: 368
  VH region of IL-17 antibody B6-16

SEQ ID NO: 886 - protein, 330 aa, Artificial Sequence [sequence omitted]

SEQ ID NO: 887 - protein, 6 aa, Artificial Sequence
  oligopeptide linker
GGGGSG

SEQ ID NO: 888 - protein, 5 aa, Artificial Sequence
  oligopeptide linker
GGSGG

SEQ ID NO: 889 - protein, 10 aa, Artificial Sequence
  oligopeptide linker
GGGGSGGGGS

SEQ ID NO: 890 - protein, 10 aa, Artificial Sequence
  oligopeptide linker
GGSGGGGSGS

SEQ ID NO: 891 - protein, 13 aa, Artificial Sequence
  oligopeptide linker
GGSGGGGSGGGGS

SEQ ID NO: 892 - protein, 14 aa, Artificial Sequence
  oligopeptide linker
GGGGSGGGGSGGGG

SEQ ID NO: 893 - protein, 15 aa, Artificial Sequence
  oligopeptide linker
GGGGSGGGGSGGGGS

SEQ ID NO: 894 - protein, 6 aa, Artificial Sequence
  oligopeptide linker
ASTKGP

SEQ ID NO: 895 - protein, 13 aa, Artificial Sequence
  oligopeptide linker
ASTKGPSVFPLAP

SEQ ID NO: 896 - protein, 5 aa, Artificial Sequence
  oligopeptide linker
TVAAP

SEQ ID NO: 897 - protein, 12 aa, Artificial Sequence
  oligopeptide linker
TVAAPSVFIFPP

SEQ ID NO: 898 - protein, 16 aa, Artificial Sequence
  oligopeptide linker
AKTTPKLEEGEFSEAR

SEQ ID NO: 899 - protein, 17 aa, Artificial Sequence
  oligopeptide linker
AKTTPKLEEGEFSEARV

SEQ ID NO: 900 - protein, 9 aa, Artificial Sequence
  oligopeptide linker
AKTTPKLGG

SEQ ID NO: 901 - protein, 10 aa, Artificial Sequence
  oligopeptide linker
SAKTTPKLGG

SEQ ID NO: 902 - protein, 6 aa, Artificial Sequence
  oligopeptide linker
SAKTTP

SEQ ID NO: 903 - protein, 6 aa, Artificial Sequence
  oligopeptide linker
RADAAP

SEQ ID NO: 904 - protein, 9 aa, Artificial Sequence
  oligopeptide linker
RADAAPTVS

SEQ ID NO: 905 - protein, 12 aa, Artificial Sequence
  oligopeptide linker
RADAAAAGGPGS

SEQ ID NO: 906 - protein, 27 aa, Artificial Sequence
  oligopeptide linker
RADAAAAGGGGSGGGGSGGGGSGGGGS

SEQ ID NO: 907 - protein, 18 aa, Artificial Sequence
  oligopeptide linker
SAKTTPKLEEGEFSEARV

SEQ ID NO: 908 - protein, 5 aa, Artificial Sequence
  oligopeptide linker
ADAAP

SEQ ID NO: 909 - protein, 12 aa, Artificial Sequence
  oligopeptide linker
ADAAPTVSIFPP

SEQ ID NO: 910 - protein, 6 aa, Artificial Sequence
  oligopeptide linker
QPKAAP

SEQ ID NO: 911 - protein, 13 aa, Artificial Sequence
  oligopeptide linker
QPKAAPSVTLFPP

SEQ ID NO: 912 - protein, 6 aa, Artificial Sequence
  oligopeptide linker
AKTTPP

SEQ ID NO: 913 - protein, 13 aa, Artificial Sequence
  oligopeptide linker
AKTTPPSVTPLAP

SEQ ID NO: 914 - protein, 6 aa, Artificial Sequence
  oligopeptide linker
AKTTAP

SEQ ID NO: 915 - protein, 13 aa, Artificial Sequence
  oligopeptide linker
AKTTAPSVYPLAP

SEQ ID NO: 916 - protein, 15 aa, Artificial Sequence
  oligopeptide linker
GENKVEYAPALMALS

SEQ ID NO: 917 - protein, 15 aa, Artificial Sequence
  oligopeptide linker
GPAKELTPLKEAKVS

SEQ ID NO: 918 - protein, 15 aa, Artificial Sequence
  oligopeptide linker
GHEAAAVMQVQYPAS

SEQ ID NO: 919 - protein, 5 aa, Artificial Sequence
  CDR-H1 consensus sequence
  MISC_FEATURE (1)..(1): D or S
  MISC_FEATURE (3)..(3): E or G
  MISC_FEATURE (4)..(4): I, M, V, or F
XYXXH

SEQ ID NO: 920 - protein, 17 aa, Artificial Sequence
  CDR-H2 consensus sequence
  MISC_FEATURE (2)..(2): T, I, or N
  MISC_FEATURE (3)..(3): D, H, or W
  MISC_FEATURE (4)..(4): P, or not present
  MISC_FEATURE (5)..(5): E, G, or S
  MISC_FEATURE (6)..(6): S, N, or D
  MISC_FEATURE (8)..(8): G or T
  MISC_FEATURE (10)..(10): L, A, T, or F
  MISC_FEATURE (11)..(11): H or Y
  MISC_FEATURE (13)..(13): P, Q, or S
  MISC_FEATURE (14)..(14): K, A, or N
  MISC_FEATURE (15)..(15): F or L
  MISC_FEATURE (16)..(16): D, K, or R
  MISC_FEATURE (17)..(17): G, D, or S
VXXXXXGXTXXNXXXXX

SEQ ID NO: 921 - protein, 12 aa, Artificial Sequence
  CDR-H3 consensus sequence
  MISC_FEATURE (1)..(1): Y, F, or D
  MISC_FEATURE (2)..(2): Y, L, S, or G
  MISC_FEATURE (3)..(3): K, T, R, or Y
  MISC_FEATURE (4)..(4): Y or W
  MISC_FEATURE (5)..(5): E, D, or I
  MISC_FEATURE (6)..(6): S, G, or Y
  MISC_FEATURE (7)..(7): F, Y, or T
  MISC_FEATURE (8)..(8): Y, F, or M
  MISC_FEATURE (9)..(9): G, T, or is not present
  MISC_FEATURE (10)..(10): M, or is not present
XXXXXXXXXXDY

SEQ ID NO: 922 - protein, 16 aa, Artificial Sequence
  CDR-L1 consensus sequence
  MISC_FEATURE (1)..(1): S, K, or R
  MISC_FEATURE (2)..(2): A or S
  MISC_FEATURE (4)..(4): S or Q
  MISC_FEATURE (5)..(5): S, or is not present
  MISC_FEATURE (6)..(6): L, or is not present
  MISC_FEATURE (7)..(7): V, or is not present
  MISC_FEATURE (8)..(8): H, or is not present
  MISC_FEATURE (9)..(9): S, or is not present
  MISC_FEATURE (10)..(10): S, N, or is not present
  MISC_FEATURE (11)..(11): S, V, or G
  MISC_FEATURE (12)..(12): I, N, or S
  MISC_FEATURE (13)..(13): S, N, T, or I
  MISC_FEATURE (14)..(14): Y or D
  MISC_FEATURE (15)..(15): M, V, L, or I
  MISC_FEATURE (16)..(16): C, A, H, Y, or G
XXSXXXXXXXXXXXXX

SEQ ID NO: 923 - protein, 7 aa, Artificial Sequence
  CDR-L2 consensus sequence
  MISC_FEATURE (1)..(1): D, Y, K, A, or H
  MISC_FEATURE (2)..(2): T, A, or V
  MISC_FEATURE (3)..(3): S or F
  MISC_FEATURE (4)..(4): K, N, or E
  MISC_FEATURE (5)..(5): L or R
  MISC_FEATURE (6)..(6): A, Y, or F
  MISC_FEATURE (7)..(7): S or T
XXXXXXX

SEQ ID NO: 924 - protein, 9 aa, Artificial Sequence
  CDR-L3 consensus sequence
  MISC_FEATURE (1)..(1): Q, S, or H
  MISC_FEATURE (3)..(3): R, D, S, or G
  MISC_FEATURE (4)..(4): S, Y, or T
  MISC_FEATURE (5)..(5): S, G, or H
  MISC_FEATURE (6)..(6): Y, S, V, or A
  MISC_FEATURE (7)..(7): P, or is not present
  MISC_FEATURE (8)..(8): W, Y, or L
XQXXXXXXT

SEQ ID NO: 925 - protein, 5 aa, Artificial Sequence
  CDR-H1 consensus sequence
  MISC_FEATURE (1)..(1): N, A, D, or S
  MISC_FEATURE (2)..(2): Y, F, or L
  MISC_FEATURE (3)..(3): G, D, or A
  MISC_FEATURE (4)..(4): M or I
  MISC_FEATURE (5)..(5): H, D, or S
XXXXX

SEQ ID NO: 926 - protein, 17 aa, Artificial Sequence
  CDR-H2 consensus sequence
  MISC_FEATURE (1)..(1): V, M, or G
  MISC_FEATURE (2)..(2): I, T, M, or F
  MISC_FEATURE (3)..(3): S, N, T, or D
  MISC_FEATURE (4)..(4): Y or P
  MISC_FEATURE (5)..(5): D, N, or I
  MISC_FEATURE (6)..(6): G, S, L, or E
  MISC_FEATURE (7)..(7): S or G
  MISC_FEATURE (8)..(8): N, T, or E
  MISC_FEATURE (9)..(9): K, T, or A
  MISC_FEATURE (10)..(10): Y, G, N, or V
  MISC_FEATURE (11)..(11): Y or V
  MISC_FEATURE (13)..(13): D, P, or Q
  MISC_FEATURE (14)..(14): S, K, or N
  MISC_FEATURE (15)..(15): V or F
  MISC_FEATURE (16)..(16): K, R, or Q
XXXXXXXXXXXAXXXXG

SEQ ID NO: 927 - protein, 17 aa, Artificial Sequence
  CDR-H3 consensus sequence
  MISC_FEATURE (1)..(1): V, S, E, or I
  MISC_FEATURE (2)..(2): G, S, P, or R
  MISC_FEATURE (3)..(3): A, E, N, or P
  MISC_FEATURE (4)..(4): S, D, or W
  MISC_FEATURE (5)..(5): G, E, F, or L
  MISC_FEATURE (6)..(6): D, G, or W
  MISC_FEATURE (7)..(7): Y, I, N, or G
  MISC_FEATURE (8)..(8): Y, T, G, or A
  MISC_FEATURE (9)..(9): Y or I
  MISC_FEATURE (10)..(10): S, G, or Y
  MISC_FEATURE (11)..(11): Y, F, or T
  MISC_FEATURE (12)..(12): G, T, or is not present
  MISC_FEATURE (13)..(13): L, H, or is not present
  MISC_FEATURE (14)..(14): H, or is not present
  MISC_FEATURE (15)..(15): F, or is not present
  MISC_FEATURE (17)..(17): V, N, or Y
XXXXXXXXXXXXXXXDX

SEQ ID NO: 928 - protein, 13 aa, Artificial Sequence
  CDR-L1 consensus sequence
  MISC_FEATURE (1)..(1): S, R, or K
  MISC_FEATURE (2)..(2): G or A
  MISC_FEATURE (3)..(3): S or D
  MISC_FEATURE (4)..(4): N, K, or Q
  MISC_FEATURE (5)..(5): S, or is not present
  MISC_FEATURE (6)..(6): N, or is not present
  MISC_FEATURE (7)..(7): I, L, N, or D
  MISC_FEATURE (8)..(8): G or I
  MISC_FEATURE (9)..(9): S, N, G, or D
  MISC_FEATURE (10)..(10): H, R, S, or D
  MISC_FEATURE (11)..(11): S, Y, A, or D
  MISC_FEATURE (12)..(12): V, A, L, or M
  MISC_FEATURE (13)..(13): N, C, or H
XXXXXXXXXXXXX

SEQ ID NO: 929 - protein, 7 aa, Artificial Sequence
  CDR-L2 consensus sequence
  MISC_FEATURE (1)..(1): G, Q, Y, or E
  MISC_FEATURE (2)..(2): I, D, or A
  MISC_FEATURE (3)..(3): G, N, S, or T
  MISC_FEATURE (4)..(4): Q, K, or T
  MISC_FEATURE (5)..(5): R, S, or L
  MISC_FEATURE (6)..(6): P, I, or V
  MISC_FEATURE (7)..(7): Sor P
XXXXXXX

SEQ ID NO: 930 - protein, 11 aa, Artificial Sequence
  CDR-L3 consensus sequence
  MISC_FEATURE (1)..(1): A, Q, H, or L
  MISC_FEATURE (2)..(2): T or Q
  MISC_FEATURE (3)..(3): W, S, or H
  MISC_FEATURE (4)..(4): D or T
  MISC_FEATURE (5)..(5): D or S
  MISC_FEATURE (6)..(6): S, T, L, or F
  MISC_FEATURE (7)..(7): L, T, or P
  MISC_FEATURE (8)..(8): G, H, or Y
  MISC_FEATURE (9)..(9): G, S, or T
  MISC_FEATURE (10)..(10): Y, or is not present
  MISC_FEATURE (11)..(11): V, or is not present
XXXXXXXXXXX

SEQ ID NO: 931 - protein, 119 aa, Artificial Sequence; identical to SEQ ID NO: 785
  humanized antibody VH

SEQ ID NO: 932 - protein, 108 aa, Artificial Sequence
  humanized antibody Vk
NIVMTQSPSSLSASVGDRVTITCKASQSVSIDVGWFQQKPGKSPKLLIYHASNRYTGVPSRFSGSGSGTDFTFTISSLQPEDFATYFCQQDYSSPYTFGQGTKLEIKR

SEQ ID NO: 933 - protein, 108 aa, Artificial Sequence
  humanized antibody Vk
NIVMTQSPATLSVSPGERATLSCKASQSVSIDVGWFQQKPGQSPRLLIYHASNRYTGVPARFSGSGSGTDFTLTISSLQPEDFAVYFCQQDYSSPYTFGQGTKLEIKR

What is claimed is:

1. An antibody or antigen binding portion thereof comprising an antigen binding domain, wherein the antibody or antigen binding portion thereof binds human IL-17, and the antigen binding domain comprises six CDRs: CDR-H1, CDR-H2, CDR-H3, CDR-L1, CDR-L2, and CDR-L3, wherein:

CDR-H1 has an amino acid sequence S-Y-G-I-S (residues 31-35 of SEQ ID NO:46) or a modification of said amino acid sequence by a substitution of at least one amino acid residue, wherein:

the substitution of S at position 1 is selected from the group consisting of G, T, V, and R;

the substitution of G at position 3 is selected from the group consisting of D, V, S, A, C, and I;
the substitution of I at position 4 is selected from the group consisting of F, T, Y, M, and V; and
the substitution of S at position 5 is selected from the group consisting of G, C, N, V, and H;
CDR-H2 has an amino acid sequence G-I-T-P-I-L-G-T-A-N-Y-A-Q-K-F-Q-G (residues 50-66 of SEQ ID NO:46) or a modification of said amino acid sequence by a substitution of at least one amino acid residue, wherein:
the substitution of I at position 2 is V;
the substitution of P at position 4 is selected from the group consisting of H, N, T, L, I, V, S, and F;
the substitution of I at position 5 is selected from the group consisting of F, I, M, V, S, and L;
the substitution of L at position 6 is F;
the substitution of G at position 7 is selected from the group consisting of M, L, E, and A;
the substitution of T at position 8 is selected from the group consisting of I, S, W, A, F, L, M, V, and H;
the substitution of A at position 9 is selected from the group consisting of T, V, S, E, D, P, I, G, and R;
the substitution of N at position 10 is selected from the group consisting of D, Y, S, T, V, and I; and
the substitution of G at position 17 is D;
CDR-H3 has an amino acid sequence E-P-N-D-F-W-N-G-Y-Y-T-T-H-H-F-D-Y (residues 99-115 of SEQ ID NO:46) or a modification of said amino acid sequence by substitution of at least one amino acid residue, wherein:
the substitution of E at position 1 is selected from the group consisting of D and V;
the substitution of P at position 2 is selected from the group consisting of S and T;
the substitution of N at position 3 is selected from the group consisting of S, T, and H;
the substitution of D at position 4 is selected from the group consisting of E and A;
the substitution of Y at position 10 is F;
the substitution of T at position 11 is selected from the group consisting of A, S, D, P, N, C, and V;
the substitution of H at position 13 is selected from the group consisting of D, Q, N, and L;
the substitution of H at position 14 is selected from the group consisting of D, Y, and N;
the substitution of F at position 15 is selected from the group consisting of L and Y; and
the substitution of Y at position 17 is selected from the group consisting of S, L, N, F, C, I, H, A, and D;
CDR-L1 has an amino acid sequence R-A-S-Q-N-I-G-S-A-L-H (residues 24-34 of SEQ ID NO:47) or a modification of said amino acid sequence by substitution of at least one amino acid residue, wherein:
the substitution of R at position 1 is W;
the substitution of A at position 2 is V;
the substitution of N at position 5 is selected from the group consisting of D, E, A, and I;
the substitution of G at position 7 is selected from the group consisting of D and E;
the substitution of S at position 8 is selected from the group consisting of Y, A, E, F, T, and G; and
the substitution of A at position 9 is selected from the group consisting of E, D, S, and G;
CDR-L2 has an amino acid sequence: Y-A-S-Q-S-I-S (residues 50-56 of SEQ ID NO:47) or a modification of said amino acid sequence by substitution of at least one amino acid residue, wherein:
the substitution of Q at position 4 is selected from the group consisting of H, Y, E, N, S, and W;
the substitution of S at position 5 is selected from the group consisting of P and C;
the substitution of I at position 6 is selected from the group consisting of V, T, N, A, M, L, G, S, F, P, and Q; and
the substitution of S at position 7 is P; and
CDR-L3 has an amino acid sequence: H-Q-S-T-S-L-P-H-T (residues 89-97 of SEQ ID NO:47) or a modification of said amino acid sequence by substitution of at least one amino acid residue, wherein;
the substitution of S at position 3 is selected from the group consisting of T and G;
the substitution of T at position 4 is selected from the group consisting of D, A, Y, S, F, N, I, E, and M;
the substitution of S at position 5 is selected from the group consisting of D, N, G, I, T, F, Y, W, C, E, R, V, L, and M;
the substitution of H at position 8 is selected from the group consisting of Y, Q, F, I, V, D, and N; and
the substitution of T at position 9 is selected from the group consisting of S, A, I, N, and L; and
wherein said substitution of at least one amino acid residue does not inhibit the ability of said antibody or antigen binding portion thereof to bind human IL-17.

2. The antibody or antigen binding portion thereof according to claim 1, wherein the CDRs are selected from the group consisting of:
SYGIS, residues 31-35 of SEQ ID NO:359 (CDR-H1),
SYGIC, residues 31-35 of SEQ ID NO:362 (CDR-H1),
SYGIV, residues 31-35 of SEQ ID NO:363 (CDR-H1),
GYGIS, residues 31-35 of SEQ ID NO:368 (CDR-H1),
TYGIS, residues 31-35 of SEQ ID NO:372 (CDR-H1),
GYGTS, residues 31-35 of SEQ ID NO:383 (CDR-H1),
GYGIG, residues 31-35 of SEQ ID NO:389 (CDR-H1),
SYGIG, residues 31-35 of SEQ ID NO:394 (CDR-H1),
SYGFS, residues 31-35 of SEQ ID NO:405 (CDR-H1),
SYGYN, residues 31-35 of SEQ ID NO:406 (CDR-H1),
TYGMN, residues 31-35 of SEQ ID NO:408 (CDR-H1),
SYGFG, residues 31-35 of SEQ ID NO:409 (CDR-H1),
SYGTS, residues 31-35 of SEQ ID NO:430 (CDR-H1),
SYCTS, residues 31-35 of SEQ ID NO:431 (CDR-H1),
SYSTS, residues 31-35 of SEQ ID NO:432 (CDR-H1),
SYVIS, residues 31-35 of SEQ ID NO:439 (CDR-H1),
VYGFS, residues 31-35 of SEQ ID NO:440 (CDR-H1),
TYGFS, residues 31-35 of SEQ ID NO:441 (CDR-H1),
SYVFS, residues 31-35 of SEQ ID NO:442 (CDR-H1),
SYGVS, residues 31-35 of SEQ ID NO:443 (CDR-H1),
SYDFS, residues 31-35 of SEQ ID NO:445 (CDR-H1),
GYDFS, residues 31-35 of SEQ ID NO:447 (CDR-H1),
SYIIS, residues 31-35 of SEQ ID NO:452 (CDR-H1),
SYGYS, residues 31-35 of SEQ ID NO:453 (CDR-H1),
SYDYS, residues 31-35 of SEQ ID NO:457 (CDR-H1),
GYVYS, residues 31-35 of SEQ ID NO:460 (CDR-H1),
RYDFS, residues 31-35 of SEQ ID NO:464 (CDR-H1),
SYVVS, residues 31-35 of SEQ ID NO:468 (CDR-H1),
SYGFH, residues 31-35 of SEQ ID NO:469 (CDR-H1),
GITTFFGITDYAQKFQG, residues 50-66 of SEQ ID NO:359 (CDR-H2),
GITNFFGWTDYAQKFQG, residues 50-66 of SEQ ID NO:360 (CDR-H2),
GITNFFGAVDYAQKFQG, residues 50-66 of SEQ ID NO:361 (CDR-H2),
GITNFFGTTDYAQKFQG, residues 50-66 of SEQ ID NO:362 (CDR-H2),
GITTFFGATDYAQKFQG, residues 50-66 of SEQ ID NO:363 (CDR-H2), GITIFFGTVDYAQKFQG, residues 50-66 of SEQ ID NO:366 (CDR-H2),
GITHFFGTVDYAQKFQG, residues 50-66 of SEQ ID NO:367 (CDR-H2),
GITPFFGWADYAQKFQG, residues 50-66 of SEQ ID NO:368 (CDR-H2),
GITPFFGWTDYAQKFQG, residues 50-66 of SEQ ID NO:370 (CDR-H2),
GITHFFGSTDYAQKFQG, residues 50-66 of SEQ ID NO:374 (CDR-H2),
GITLFFGTVDYAQKFQG, residues 50-66 of SEQ ID NO:378 (CDR-H2),
GITLFFGISDYAQKFQG, residues 50-66 of SEQ ID NO:380 (CDR-H2),
GITNFFGMEDYAQKFQG, residues 50-66 of SEQ ID NO:382 (CDR-H2),
GITHFFGAVDYAQKFQG, residues 50-66 of SEQ ID NO:383 (CDR-H2),
GITNFFGIVDYAQKFQG, residues 50-66 of SEQ ID NO:387 (CDR-H2),
GITPFFGFADYAQKFQG, residues 50-66 of SEQ ID NO:389 (CDR-H2),
GVTTFFGFADYAQKFQG, residues 50-66 of SEQ ID NO:390 (CDR-H2),
GITTFFGVADYAQKFQGR, residues 50-66 of SEQ ID NO:391 (CDR-H2),
GITHFFGMTDYAQKFQG, residues 50-66 of SEQ ID NO:392 (CDR-H2),
GITTFFGTTDYAQKFQG, residues 50-66 of SEQ ID NO:393 (CDR-H2),
GITNFFGVEDYAQKFQG, residues 50-66 of SEQ ID NO:394 (CDR-H2),
GITHFFGISDYAQKFQG, residues 50-66 of SEQ ID NO:395 (CDR-H2),
GITNFFGIRDYAQKFQG, residues 50-66 of SEQ ID NO:396 (CDR-H2),
GITVFFGTADYAQKFQG, residues 50-66 of SEQ ID NO:397 (CDR-H2),
GITLFFGTTDYAQKFQG, residues 50-66 of SEQ ID NO:398 (CDR-H2),
GITHFFGMVDYAQKFQG, residues 50-66 of SEQ ID NO:399 (CDR-H2),
GITNFFGSTDYAQKFQG, residues 50-66 of SEQ ID NO:401 (CDR-H2),
GITHFFGITDYAQKFQG, residues 50-66 of SEQ ID NO:403 (CDR-H2),
GITVFFGHVYYAQKFQG, residues 50-66 of SEQ ID NO:405 (CDR-H2),
GITPFFGTADYAQKFQG, residues 50-66 of SEQ ID NO:406 (CDR-H2),
GITPFFGLADYAQKFQG, residues 50-66 of SEQ ID NO:407 (CDR-H2),
GITPFFGIADYAQKFQG, residues 50-66 of SEQ ID NO:409 (CDR-H2),
GITPILGTANYAQKFQG, residues 50-66 of SEQ ID NO:410 (CDR-H2),
GITPILGTANYAQKFQD, residues 50-66 of SEQ ID NO:421 (CDR-H2),
GITFFFGAADYAQKFQG, residues 50-66 of SEQ ID NO:429 (CDR-H2),
GITHFFGTTDYAQKFQG, residues 50-66 of SEQ ID NO:430 (CDR-H2),
GITHFFGSADYAQKFQG, residues 50-66 of SEQ ID NO:431 (CDR-H2),
GITHFFGTADYAQKFQG, residues 50-66 of SEQ ID NO:432 (CDR-H2),
GITHFFLTTDYAQKFQG, residues 50-66 of SEQ ID NO:435 (CDR-H2),
GITHMFATTDYAQKFQG, residues 50-66 of SEQ ID NO:436 (CDR-H2),
GITPFLGATDYAQKFQG, residues 50-66 of SEQ ID NO:437 (CDR-H2),
GITPFFGFIDYAQKFQG, residues 50-66 of SEQ ID NO:438 (CDR-H2),
GITPFFGTVDYAQKFQG, residues 50-66 of SEQ ID NO:439 (CDR-H2),
GITPFLGTVDYAQKFQG, residues 50-66 of SEQ ID NO:440 (CDR-H2),
GITTFLGTVNYAQKFQG, residues 50-66 of SEQ ID NO:441 (CDR-H2),
GITPLLGISDYAQKFQG, residues 50-66 of SEQ ID NO:442 (CDR-H2),
GITTILGTSDYAQKFQG, residues 50-66 of SEQ ID NO:443 (CDR-H2),
GITPIFGTGDYAQKFQG, residues 50-66 of SEQ ID NO:444 (CDR-H2),
GITTFFESADYAQKFQG, residues 50-66 of SEQ ID NO:445 (CDR-H2),
GITTFFGLADYAQKFQG, residues 50-66 of SEQ ID NO:446 (CDR-H2),
GITPFFGSAYYAQKFQG, residues 50-66 of SEQ ID NO:447 (CDR-H2),
GITPFFGSTDYAQKFQG, residues 50-66 of SEQ ID NO:450 (CDR-H2),
GITPFFGIVNYAQKFQG, residues 50-66 of SEQ ID NO:457 (CDR-H2),
GITTFFGASTYAQKFQG, residues 50-66 of SEQ ID NO:458 (CDR-H2),
GITSFFGTEDYAQKFQG, residues 50-66 of SEQ ID NO:459 (CDR-H2),
GITPFLGTAIYAQKFQG, residues 50-66 of SEQ ID NO:461 (CDR-H2),
GITPILGTENYAQKFQG, residues 50-66 of SEQ ID NO:462 (CDR-H2),
GITPFLGMSSYAQKFQG, residues 50-66 of SEQ ID NO:463 (CDR-H2),
GITPFLGTSNYAQKFQG, residues 50-66 of SEQ ID NO:464 (CDR-H2),
GITPFLGFSNYAQKFQG, residues 50-66 of SEQ ID NO:465 (CDR-H2),
GITPFLGTADYAQKFQG, residues 50-66 of SEQ ID NO:466 (CDR-H2),
GITTFLGTVVYAQKFQG, residues 50-66 of SEQ ID NO:467 (CDR-H2),
GITPFFGTDNYAQKFQG, residues 50-66 of SEQ ID NO:469 (CDR-H2),
GITPFFGLGTYAQKFQG, residues 50-66 of SEQ ID NO:470 (CDR-H2),
GITPFFGAANYAQKFQG, residues 50-66 of SEQ ID NO:471 (CDR-H2),
DPNEFWNGYYATHDFDY, residues 99-115 of SEQ ID NO:359 (CDR-H3),
DPNEFWNGYYATHDFDI, residues 99-115 of SEQ ID NO:364 (CDR-H3),
DPNEFWNGYYDTHDFDS, residues 99-115 of SEQ ID NO:365 (CDR-H3),
DPNEFWNGYYNTHDFDY, residues 99-115 of SEQ ID NO:366 (CDR-H3),
DPNEFWNGYYDTHDLDY, residues 99-115 of SEQ ID NO:367 (CDR-H3),
DPNEFWNGYYDTHHFDY, residues 99-115 of SEQ ID NO:368 (CDR-H3), VPNEFWNGYYATDYFDN, residues 99-115 of SEQ ID NO:372 (CDR-H3),
EPNEFWNGYYTTHDFDS, residues 99-115 of SEQ ID NO:373 (CDR-H3),
VPNEFWNGYYATQDFDY, residues 99-115 of SEQ ID NO:375 (CDR-H3),
VPNEFWNGYYATDYFDY, residues 99-115 of SEQ ID NO:376 (CDR-H3),
EPNEFWNGYYSTHDFDY, residues 99-115 of SEQ ID NO:378 (CDR-H3),
EPNEFWNGYYATHDFDY, residues 99-115 of SEQ ID NO:379 (CDR-H3),
EPNEFWNGYYTTHDFDA, residues 99-115 of SEQ ID NO:381 (CDR-H3),
DPHEFWNGYYATHDFDY, residues 99-115 of SEQ ID NO:384 (CDR-H3),
DPNEFWNGYYSTHDFDS, residues 99-115 of SEQ ID NO:389 (CDR-H3),
EPNEFWNGYFATNDFDY, residues 99-115 of SEQ ID NO:402 (CDR-H3),
EPNDFWNGYYDTHDFDS, residues 99-115 of SEQ ID NO:403 (CDR-H3),
ESSEFWNGYYCTQDFDL, residues 99-115 of SEQ ID NO:406 (CDR-H3),
ESSEFWNGYYVTNDFDY, residues 99-115 of SEQ ID NO:409 (CDR-H3),
ESNEFWNGYYPTLDLDS, residues 99-115 of SEQ ID NO:410 (CDR-H3),
ESNEFWNGYYPTQDYDF, residues 99-115 of SEQ ID NO:411 (CDR-H3),
ESSAFWNGYYNTNDLDY, residues 99-115 of SEQ ID NO:412 (CDR-H3),
ESTEFWNGYYNTNDYDN, residues 99-115 of SEQ ID NO:413 (CDR-H3),
ESNDFWNGYYTTDDFDY, residues 99-115 of SEQ ID NO:414 (CDR-H3),
ESNDFWNGYYTTDDLDY, residues 99-115 of SEQ ID NO:415 (CDR-H3),
ESNDFWNGYYTTDDFDC, residues 99-115 of SEQ ID NO:416 (CDR-H3),
VPNEFWNGYFPTQDFDY, residues 99-115 of SEQ ID NO:417 (CDR-H3),
ETNEFWNGYFPTQDFDY, residues 99-115 of SEQ ID NO:418 (CDR-H3),
EPNEFWNGYFPTQDFDY, residues 99-115 of SEQ ID NO:419 (CDR-H3),
EPNEFWNGYFPTLDFDC, residues 99-115 of SEQ ID NO:420 (CDR-H3),
EPNDFWNGYYATDNFDY, residues 99-115 of SEQ ID NO:422 (CDR-H3),
EPNDFWNGYYSTDHFDC, residues 99-115 of SEQ ID NO:423 (CDR-H3),
VPNDFWNGYFATDYFDD, residues 99-115 of SEQ ID NO:424 (CDR-H3),
EPNDFWNGYFATDHFDF, residues 99-115 of SEQ ID NO:425 (CDR-H3),
EPNDFWNGYYDTDHFDY, residues 99-115 of SEQ ID NO:426 (CDR-H3),
DPNEFWNGYYATHDFDH, residues 99-115 of SEQ ID NO:427 (CDR-H3),
EPNEFWNGYYSTDHFDY, residues 99-115 of SEQ ID NO:428 (CDR-H3),
EPNDFWNGYYTTHHFDY, residues 99-115 of SEQ ID NO:429 (CDR-H3),
RASQIIGSELH, residues 24-34 of SEQ ID NO:473 (CDR-L1),
RASQDIGSELH, residues 24-34 of SEQ ID NO:474 (CDR-L1),
RASQNIGSELH, residues 24-34 of SEQ ID NO:477 (CDR-L1),
RASQNIGSALH, residues 24-34 of SEQ ID NO:479 (CDR-L1),
RASQDIGSALH, residues 24-34 of SEQ ID NO:488 (CDR-L1),
RASQDIGAALH, residues 24-34 of SEQ ID NO:491 (CDR-L1),
RASQNIGSSLH, residues 24-34 of SEQ ID NO:492 (CDR-L1),
RASQDIGYELH, residues 24-34 of SEQ ID NO:497 (CDR-L1),
RASQEIGFALH, residues 24-34 of SEQ ID NO:499 (CDR-L1),
RASQNIGAELH, residues 24-34 of SEQ ID NO:500 (CDR-L1),
RASQDIGSGLH, residues 24-34 of SEQ ID NO:505 (CDR-L1),
RASQDIGSDLH, residues 24-34 of SEQ ID NO:506 (CDR-L1),
RASQDIDSDLH, residues 24-34 of SEQ ID NO:507 (CDR-L1),
RASQDIGEALH, residues 24-34 of SEQ ID NO:516 (CDR-L1),
RASQEIGASLH, residues 24-34 of SEQ ID NO:517 (CDR-L1),
RASQDIGGELH, residues 24-34 of SEQ ID NO:518 (CDR-L1),
RASQDIETELH, residues 24-34 of SEQ ID NO:519 (CDR-L1),
RASQNIGSDLH, residues 24-34 of SEQ ID NO:520 (CDR-L1),
RASQNIGYELH, residues 24-34 of SEQ ID NO:521 (CDR-L1),
RASQNIGTELH, residues 24-34 of SEQ ID NO:522 (CDR-L1),
RASQNIGSGLH, residues 24-34 of SEQ ID NO:530 (CDR-L1),
RASQNIDSELH, residues 24-34 of SEQ ID NO:533 (CDR-L1),
RASQNIDSDLH, residues 24-34 of SEQ ID NO:535 (CDR-L1),
RASQNIGEELH, residues 24-34 of SEQ ID NO:537 (CDR-L1),
RASQAIGSELH, residues 24-34 of SEQ ID NO:539 (CDR-L1),
YASHSIS, residues 50-56 of SEQ ID NO:473 (CDR-L2),
YASHSGS, residues 50-56 of SEQ ID NO:476 (CDR-L2),
YASWSQS, residues 50-56 of SEQ ID NO:477 (CDR-L2),
YASNSIS, residues 50-56 of SEQ ID NO:478 (CDR-L2),
YASQSIS, residues 50-56 of SEQ ID NO:479 (CDR-L2),
YASHSVS, residues 50-56 of SEQ ID NO:489 (CDR-L2),
YASYSVS, residues 50-56 of SEQ ID NO:490 (CDR-L2),
YASHSNP, residues 50-56 of SEQ ID NO:491 (CDR-L2),
YASYPIS, residues 50-56 of SEQ ID NO:493 (CDR-L2),
YASHSNS, residues 50-56 of SEQ ID NO:495 (CDR-L2),
YASESMS, residues 50-56 of SEQ ID NO:496 (CDR-L2),
YASYSSS, residues 50-56 of SEQ ID NO:498 (CDR-L2),
YASHSTS, residues 50-56 of SEQ ID NO:502 (CDR-L2),
YASHSMS, residues 50-56 of SEQ ID NO:504 (CDR-L2),
YASYSTS, residues 50-56 of SEQ ID NO:509 (CDR-L2),
YASESIS, residues 50-56 of SEQ ID NO:510 (CDR-L2),
YASHSAS, residues 50-56 of SEQ ID NO:511 (CDR-L2),
YASESGS, residues 50-56 of SEQ ID NO:513 (CDR-L2),
YASSSTS, residues 50-56 of SEQ ID NO:514 (CDR-L2), YASSSLS, residues 50-56 of SEQ ID NO:515 (CDR-L2),
YASHCIS, residues 50-56 of SEQ ID NO:522 (CDR-L2),
YASESVS, residues 50-56 of SEQ ID NO:524 (CDR-L2),
YASYSIS, residues 50-56 of SEQ ID NO:530 (CDR-L2),
YASSSIS, residues 50-56 of SEQ ID NO:532 (CDR-L2),
YASSSPS, residues 50-56 of SEQ ID NO:537 (CDR-L2),
HQSYDLPHT, residues 89-97 of SEQ ID NO:473 (CDR-L3),
HQSYDLPYT, residues 89-97 of SEQ ID NO:474 (CDR-L3),
HQSYWLPNT, residues 89-97 of SEQ ID NO:475 (CDR-L3),
HQSYNLPIT, residues 89-97 of SEQ ID NO:476 (CDR-L3),
HQSMSLPHT, residues 89-97 of SEQ ID NO:478 (CDR-L3),
HQSTSLPHT, residues 89-97 of SEQ ID NO:479 (CDR-L3),
HQGTSLPHT, residues 89-97 of SEQ ID NO:486 (CDR-L3),
HQSDILPHT, residues 89-97 of SEQ ID NO:489 (CDR-L3),
HQSDILPQT, residues 89-97 of SEQ ID NO:491 (CDR-L3),
HQSDFLPHT, residues 89-97 of SEQ ID NO:492 (CDR-L3),
HQSDDLPYT, residues 89-97 of SEQ ID NO:494 (CDR-L3),
HQSSWLPHT, residues 89-97 of SEQ ID NO:495 (CDR-L3),
HQSS#LPHS, residues 89-97 of SEQ ID NO:496 (CDR-L3),
HQSSELPHT, residues 89-97 of SEQ ID NO:497 (CDR-L3),
HQSSCLPHT, residues 89-97 of SEQ ID NO:498 (CDR-L3),
HQTEELPYT, residues 89-97 of SEQ ID NO:499 (CDR-L3),
HQTDRLPYS, residues 89-97 of SEQ ID NO:500 (CDR-L3),
HQTFSLPYT, residues 89-97 of SEQ ID NO:501 (CDR-L3),
HQTDSLPYT, residues 89-97 of SEQ ID NO:502 (CDR-L3),
HQTSDLPYT, residues 89-97 of SEQ ID NO:503 (CDR-L3),
HQTNSLPYT, residues 89-97 of SEQ ID NO:504 (CDR-L3),
HQTDWLPYT, residues 89-97 of SEQ ID NO:505 (CDR-L3),
HQTFNLPYT, residues 89-97 of SEQ ID NO:507 (CDR-L3),
HQTAYLPQT, residues 89-97 of SEQ ID NO:508 (CDR-L3),
HQTDGLPYT, residues 89-97 of SEQ ID NO:509 (CDR-L3),
HQTTLLPYT, residues 89-97 of SEQ ID NO:511 (CDR-L3),
HQGFSLPHT, residues 89-97 of SEQ ID NO:512 (CDR-L3),
HQSFCLPYT, residues 89-97 of SEQ ID NO:513 (CDR-L3),
HQSTSLPYT, residues 89-97 of SEQ ID NO:514 (CDR-L3),
HQSDYLPYT, residues 89-97 of SEQ ID NO:515 (CDR-L3),
HQSDWLPYT, residues 89-97 of SEQ ID NO:516 (CDR-L3),
HQSDGLPYT, residues 89-97 of SEQ ID NO:517 (CDR-L3),
HQSNDLPYT, residues 89-97 of SEQ ID NO:518 (CDR-L3),
HQTYGLPYT, residues 89-97 of SEQ ID NO:519 (CDR-L3),
HQSMGLPYT, residues 89-97 of SEQ ID NO:520 (CDR-L3),
HQSFTLPYT, residues 89-97 of SEQ ID NO:521 (CDR-L3),
HQSESLPHT, residues 89-97 of SEQ ID NO:522 (CDR-L3),
HQSDTLPHT, residues 89-97 of SEQ ID NO:523 (CDR-L3),
HQSTNLPYT, residues 89-97 of SEQ ID NO:524 (CDR-L3),
HQSSILPHT, residues 89-97 of SEQ ID NO:525 (CDR-L3),
HQSTWLPYT, residues 89-97 of SEQ ID NO:526 (CDR-L3),
HQSAFLPYI, residues 89-97 of SEQ ID NO:527 (CDR-L3),
HQSISLPQT, residues 89-97 of SEQ ID NO:528 (CDR-L3),
HQSASLPIT, residues 89-97 of SEQ ID NO:529 (CDR-L3),
HQSAYLPYT, residues 89-97 of SEQ ID NO:530 (CDR-L3),
HQSAVLPDT, residues 89-97 of SEQ ID NO:531 (CDR-L3),
HQSSDLPYT, residues 89-97 of SEQ ID NO:532 (CDR-L3),
HQSFSLPYT, residues 89-97 of SEQ ID NO:533 (CDR-L3),
HQSAFLPYT, residues 89-97 of SEQ ID NO:534 (CDR-L3),
HQSYSLPFN, residues 89-97 of SEQ ID NO:535 (CDR-L3),
HQSYMLPYS, residues 89-97 of SEQ ID NO:536 (CDR-L3),
HQSFSLPVT, residues 89-97 of SEQ ID NO:537 (CDR-L3),
HQSISLPYT, residues 89-97 of SEQ ID NO:538 (CDR-L3),
And
HQSASLPYT, residues 89-97 of SEQ ID NO:539 (CDR-L3).

3. The antibody or antigen binding portion thereof according to claim 1, wherein the antigen binding domain comprises a heavy chain variable region (VH) comprising an amino acid sequence selected from the group consisting of SEQ ID NO:46 and SEQ ID NOS:359-472.

4. The antibody or antigen binding portion thereof according to claim 1, wherein the antigen binding domain comprises a light chain variable region (VL) comprising an amino acid sequence selected from the group consisting of SEQ ID NO:47, SEQ ID NO:553, and SEQ ID NOS:473-539.

5. The antibody or antigen binding portion thereof according to claim 1, further comprising a heavy chain immunoglobulin constant domain comprising a human IgM constant domain, a human IgG1 constant domain, a human IgG2 constant domain, a human IgG3 constant domain, a human IgG4 constant domain, a human IgE constant domain, or a human IgA constant domain.

6. The antibody or antigen binding portion thereof according to claim 5, wherein the heavy chain immunoglobulin constant domain is the human IgG1 constant domain.

7. The antibody or antigen binding portion thereof according to claim 6, wherein the human IgG1 constant domain comprises the amino acid sequence of SEQ ID NO:3 or SEQ ID NO:4.

8. The antibody or antigen binding portion thereof according to claim 1, further comprising a light chain immunoglobulin constant domain comprising a human Ig kappa constant domain or a human Ig lambda constant domain.

9. The antibody or antigen binding portion thereof according to claim 8, wherein the human Ig kappa constant domain comprises the amino acid sequence of SEQ ID NO:5.

10. The antibody or antigen binding portion thereof according to claim 8, wherein the human Ig lambda constant domain comprises the amino acid sequence of SEQ ID NO:6.

11. The antibody or antigen binding portion thereof according to claim 1, wherein the antibody or antigen binding portion thereof is an immunoglobulin molecule, an scFv, a monoclonal antibody, a human antibody, a humanized antibody, an affinity matured antibody, a chimeric antibody, a Fab fragment, an Fab' fragment, an F(ab')$_2$, an Fv, or a disulfide linked Fv.

12. The antibody or antigen binding portion thereof according to claim 11, wherein the antibody or antigen binding portion thereof is a human antibody.

13. The antibody or antigen binding portion thereof according to claim 1, wherein the antibody or antigen binding portion thereof is capable of causing an increase or decrease in the magnitude of a biological function of IL-17, compared to the magnitude of the biological function of IL-17 observed in the absence of the antibody or antigen binding portion thereof.

14. The antibody or antigen binding portion thereof according to claim 1, wherein the antibody or antigen binding portion thereof neutralizes a biological function of IL-17.

15. The antibody or antigen binding portion thereof according to claim 13, wherein the IL-17 is pro-human IL-17, mature-human IL-17, or truncated-human IL-17.

16. The antibody or antigen binding portion thereof according to claim 14, wherein the antibody or antigen binding portion thereof diminishes the ability of IL-17 to bind to its receptor.

17. The antibody or antigen binding portion thereof according to claim 16, wherein the IL-17 is pro-human IL-17, mature-human IL-17, or truncated-human IL-17.

18. The antibody or antigen binding portion thereof according to claim 13, wherein the antibody or antigen binding portion thereof has a dissociation constant ($K_D$) of at most about $10^{-7}$ M.

19. The antibody or antigen binding portion thereof according to claim 13, wherein the antibody or antigen binding portion thereof has an on rate constant ($K_{on}$) of at least about $10^2 M^{-1}s^{-1}$.

20. The antibody or antigen binding portion thereof according to claim 13, wherein the antibody or antigen binding portion thereof has an off rate ($K_{off}$) of at most about $10^{-3}s^{-1}$.

21. The antibody or antigen binding portion thereof according to claim 1, wherein the antibody or antigen binding portion thereof is conjugated to a detectable label.

22. The antibody or antigen binding portion thereof according to claim 21, wherein the detectable label is selected from the group consisting of a radiolabel, an enzyme, a fluorescent label, a luminescent label, a bioluminescent label, a magnetic label, and a biotin.

23. The antibody or antigen binding portion thereof according to claim 1, wherein the antibody or antigen binding portion thereof is conjugated to a therapeutic or cytotoxic agent.

24. The antibody or antigen binding portion thereof according to claim 23, wherein the therapeutic or cytotoxic agent is selected from the group consisting of an anti-metabolite, an alkylating agent, an antibiotic, a growth factor, a cytokine, an anti-angiogenic agent, an anti-mitotic agent, an anthracycline, a toxin, and an apoptotic agent.

25. The antibody or antigen binding portion thereof according to claim 1, wherein the antibody or antigen binding portion thereof is crystallized.

26. The crystallized antibody or antigen binding portion thereof according to claim 25, wherein the crystallized antibody or antigen binding portion thereof is a carrier-free pharmaceutical controlled release crystal.

27. A composition for the release of a crystallized antibody or antigen binding portion thereof that binds IL-17, the composition comprising:
(a) a formulation, wherein the formulation comprises a crystallized antibody or antigen binding portion thereof according to claim 25 and optionally an additional ingredient comprising an agent selected from the group consisting of albumin, sucrose, trehalose, lactitol, gelatin, hydroxypropyl-β-cyclodextrin, methoxypolyethylene glycol, and polyethylene glycol; and
(b) at least one polymeric carrier.

28. The composition according to claim 27, wherein the polymeric carrier comprises one or more polymers selected from the group consisting of a poly(acrylic acid), a poly (cyanoacrylate), a poly(amino acid), a poly(anhydride), a poly(depsipeptide), a poly(ester), a poly(lactic acid), a poly (lactic-co-glycolic acid) or PLGA, a poly(b-hydroxybutryate), a poly(caprolactone), a poly(dioxanone); a poly(ethylene glycol), a poly((hydroxypropyl)methacrylamide, a poly [(organo)phosphazene], a poly(ortho ester), a poly(vinyl alcohol), a poly(vinylpyrrolidone), a maleic anhydride-alkyl vinyl ether copolymer, a pluronic polyol, an albumin, an alginate, a cellulose, a cellulose derivative, a collagen, a fibrin, a gelatin, a hyaluronic acid, an oligosaccharide, a glycaminoglycan, a sulfated polysaccharide, and a blend and a copolymer thereof.

29. A pharmaceutical composition comprising the antibody or antigen binding portion thereof according to claim 1, and a pharmaceutically acceptable carrier.

30. The pharmaceutical composition according to claim 29, further comprising at least one additional therapeutic agent for treating a disorder in which IL-17 activity is detrimental.

31. The pharmaceutical composition according to claim 30, wherein the additional agent is selected from the group consisting of an angiogenesis inhibitor, a kinase inhibitor, a co-stimulation molecule blocker, an adhesion molecule blocker, an anti-cytokine antibody or functional binding fragment thereof, methotrexate, a corticosteroid, a cyclosporine, a rapamycin, FK506, and a non-steroidal anti-inflammatory agent.

32. The antibody or antigen binding portion thereof according to claim 1, wherein antigen binding domain comprises six CDRs: CDR-H1, CDR-H2, CDR-H3, CDR-L1, CDR-L2, and CDR-L3, wherein:
CDR-H1 has an amino acid sequence S-Y-G-I-S (residues 31-35 of SEQ ID NO:46) or a modification of said amino acid sequence by substitution of at least one amino acid residue, wherein:

the substitution of S at position 1 is selected from the group consisting of G and T;
the substitution of I at position 4 is selected from the group consisting of F, T, and Y; and
the substitution of S at position 5 is selected from the group consisting of G and N;
CDR-H2 has an amino acid sequence G-I-T-P-I-L-G-T-A-N-Y-A-Q-K-F-Q-G (residues 50-66 of SEQ ID NO:46) or a modification of said amino acid sequence by substitution of at least one amino acid residue, wherein:
the substitution of P at position 4 is selected from the group consisting of H and N;
the substitution of I at position 5 is F;
the substitution of L at position 6 is F;
the substitution of T at position 8 is selected from the group consisting of I, S, W, A, F, and L;
the substitution of A at position 9 is selected from the group consisting of T and V; and
the substitution of N at position 10 is D;
CDR-H3 has an amino acid sequence: E-P-N-D-F-W-N-G-Y-Y-T-T-H-H-F-D-Y (residues 99-115 of SEQ ID NO:46) or a modification of said amino acid sequence by substitution of at least one amino acid residue, wherein:
the substitution of E at position 1 is selected from the group consisting of D and V;
the substitution of P at position 2 is S;
the substitution of N at position 3 is S;
the substitution of D at position 4 is E; and
the substitution of T at position 11 is selected from the group consisting of A, S, D, and C;
CDR-L1 has an amino acid sequence: R-A-S-Q-N-I-G-S-A-L-H (residues 24-34 of SEQ ID NO:47) or a modification of said amino acid sequence by substitution of at least one amino acid residue, wherein:
the substitution of N at position 5 is selected from the group consisting of D, E, and A;
the substitution of S at position 8 is A and
the substitution of A at position 9 is selected from the group consisting of E, D, and S;
CDR-L2 has an amino acid sequence: Y-A-S-Q-S-I-S (residues 50-56 of SEQ ID NO:47) or a modification of said amino acid sequence by substitution of at least one amino acid residue, wherein:
the substitution of Q at position 4 is selected from the group consisting of H, Y, and N; and
the substitution of I at position 6 is selected from the group consisting of V, T, and A; and
CDR-L3 has an amino acid sequence: H-Q-S-T-S-L-P-H-T (residues 89-97 of SEQ ID NO:47) or a modification of said amino acid sequence by substitution of at least one amino acid residue, wherein;
the substitution of S at position 3 is T;
the substitution of T at position 4 is selected from the group consisting of D and A;
the substitution of S at position 5 is selected from the group consisting of G, I, T, Y, and R;
the substitution of H at position 8 is selected from the group consisting of Y and Q; and
the substitution of T at position 9 is S; and
wherein said substitution of at least one amino acid residue does not inhibit the ability of said antibody or antigen binding portion thereof to bind human IL-17.
33. The antibody or antigen binding portion thereof according to claim 32, wherein the CDRs are selected from the group consisting of:

SYGIS, residues 31-35 of SEQ ID NO:359 (CDR-H1),
GYGIS, residues 31-35 of SEQ ID NO:368 (CDR-H1),
TYGIS, residues 31-35 of SEQ ID NO:372 (CDR-H1),
GYGTS, residues 31-35 of SEQ ID NO:383 (CDR-H1),
GYGIG, residues 31-35 of SEQ ID NO:389 (CDR-H1),
SYGFS, residues 31-35 of SEQ ID NO:405 (CDR-H1),
SYGYN, residues 31-35 of SEQ ID NO:406 (CDR-H1),
GITNFFGWTDYAQKFQG, residues 50-66 of SEQ ID NO:360 (CDR-H2),
GITPFFGWADYAQKFQG, residues 50-66 of SEQ ID NO:368 (CDR-H2),
GITHFFGSTDYAQKFQG, residues 50-66 of SEQ ID NO:374 (CDR-H2),
GITHFFGAVDYAQKFQG, residues 50-66 of SEQ ID NO:383 (CDR-H2),
GITPFFGFADYAQKFQG, residues 50-66 of SEQ ID NO:389 (CDR-H2),
GITHFFGITDYAQKFQG, residues 50-66 of SEQ ID NO:403 (CDR-H2),
GITPFFGTADYAQKFQG, residues 50-66 of SEQ ID NO:406 (CDR-H2),
GITPFFGLADYAQKFQG, residues 50-66 of SEQ ID NO:407 (CDR-H2),
GITPILGTANYAQKFQG, residues 50-66 of SEQ ID NO:410 (CDR-H2),
DPNEFWNGYYATHDFDY, residues 99-115 of SEQ ID NO:359 (CDR-H3),
DPNEFWNGYYDTHHFDY, residues 99-115 of SEQ ID NO:368 (CDR-H3),
VPNEFWNGYYATDYFDN, residues 99-115 of SEQ ID NO:372 (CDR-H3),
EPNEFWNGYYTTHDFDS, residues 99-115 of SEQ ID NO:373 (CDR-H3),
DPNEFWNGYYSTHDFDS, residues 99-115 of SEQ ID NO:389 (CDR-H3),
EPNDFWNGYYDTHDFDS, residues 99-115 of SEQ ID NO:403 (CDR-H3),
ESSEFWNGYYCTQDFDL, residues 99-115 of SEQ ID NO:406 (CDR-H3),
EPNDFWNGYYTTHHFDY, residues 99-115 of SEQ ID NO:429 (CDR-H3),
RASQDIGSELH, residues 24-34 of SEQ ID NO:474 (CDR-L1),
RASQNIGSELH, residues 24-34 of SEQ ID NO:477 (CDR-L1),
RASQNIGSALH, residues 24-34 of SEQ ID NO:479 (CDR-L1),
RASQDIGSALH, residues 24-34 of SEQ ID NO:488 (CDR-L1),
RASQNIGAELH, residues 24-34 of SEQ ID NO:500 (CDR-L1),
RASQDIGSDLH, residues 24-34 of SEQ ID NO:506 (CDR-L1),
RASQEIGASLH, residues 24-34 of SEQ ID NO:517 (CDR-L1),
RASQAIGSELH, residues 24-34 of SEQ ID NO:539 (CDR-L1),
YASHSIS, residues 50-56 of SEQ ID NO:473 (CDR-L2),
YASNSIS, residues 50-56 of SEQ ID NO:478 (CDR-L2),
YASQSIS, residues 50-56 of SEQ ID NO:479 (CDR-L2),
YASHSVS, residues 50-56 of SEQ ID NO:489 (CDR-L2),
YASYSVS, residues 50-56 of SEQ ID NO:490 (CDR-L2),
YASHSTS, residues 50-56 of SEQ ID NO:502 (CDR-L2),
YASHSAS, residues 50-56 of SEQ ID NO:511 (CDR-L2),
HQSTSLPHT, residues 89-97 of SEQ ID NO:479 (CDR-L3), HQSDILPHT, residues 89-97 of SEQ ID NO:489 (CDR-L3),
HQTDRLPYS, residues 89-97 of SEQ ID NO:500 (CDR-L3),
HQTDSLPYT, residues 89-97 of SEQ ID NO:502 (CDR-L3),
HQTAYLPQT, residues 89-97 of SEQ ID NO:508 (CDR-L3),
HQSDGLPYT, residues 89-97 of SEQ ID NO:517 (CDR-L3),
HQSDTLPHT, residues 89-97 of SEQ ID NO:523 (CDR-L3),
And
HQSASLPYT, residues 89-97 of SEQ ID NO:539 (CDR-L3).

34. The antibody or antigen binding portion thereof according to claim 32, wherein the antigen binding domain comprises a heavy chain variable region (VH) comprising an amino acid sequence selected from the group consisting of: SEQ ID NOS: 368, 372, 377, 383, 389, 403, 407, 454, and 455.

35. The antibody or antigen binding portion thereof according to claim 32, wherein the antigen binding domain comprises a light chain variable region (VL) comprising an amino acid sequence selected from the group consisting of: SEQ ID NOS: 47, 489, 500, 508, 517, 523, 539, and 553.

36. The antibody or antigen binding portion thereof according to claim 32, wherein the antigen binding domain comprises a heavy chain variable region (VH) comprising three CDRs from SEQ ID NO:368 or the amino acid sequence of SEQ ID NO:368.

37. The antibody or antigen binding portion thereof according to claim 32, wherein the antigen binding domain comprises a heavy chain variable region (VH) comprising three CDRs from SEQ ID NO:372 or the amino acid sequence of SEQ ID NO:372.

38. The antibody or antigen binding portion thereof according to claim 32, wherein the antigen binding domain comprises a heavy chain variable region (VH) comprising three CDRs from SEQ ID NO:377 or the amino acid sequence of SEQ ID NO:377.

39. The antibody or antigen binding portion thereof according to claim 32, wherein the antigen binding domain comprises a heavy chain variable region (VH) comprising three CDRs from SEQ ID NO:383 or the amino acid sequence of SEQ ID NO:383.

40. The antibody or antigen binding portion thereof according to claim 32, wherein the antigen binding domain comprises a heavy chain variable region (VH) comprising three CDRs from SEQ ID NO:389 or the amino acid sequence of SEQ ID NO:389.

41. The antibody or antigen binding portion thereof according to claim 32, wherein the antigen binding domain comprises a heavy chain variable region (VH) comprising three CDRs from SEQ ID NO:403 or the amino acid sequence of SEQ ID NO:403.

42. The antibody or antigen binding portion thereof according to claim 32, wherein the antigen binding domain comprises a heavy chain variable region (VH) comprising three CDRs from SEQ ID NO:407 or the amino acid sequence of SEQ ID NO:407.

43. The antibody or antigen binding portion thereof according to claim 32, wherein the antigen binding domain comprises a heavy chain variable region (VH) comprising three CDRs from SEQ ID NO:454 or the amino acid sequence of SEQ ID NO:454.

44. The antibody or antigen binding portion thereof according to claim 32, wherein the antigen binding domain comprises a heavy chain variable region (VH) comprising three CDRs from SEQ ID NO:455 or the amino acid sequence of SEQ ID NO:455.

45. The antibody or antigen binding portion thereof according to claim 32, wherein the antigen binding domain comprises a light chain variable region (VL) comprising three CDRs from SEQ ID NO:47 or the amino acid sequence of SEQ ID NO:47.

46. The antibody or antigen binding portion thereof according to claim 32, wherein the antigen binding domain comprises a light chain variable region (VL) comprising three CDRs from SEQ ID NO:489 or the amino acid sequence of SEQ ID NO:489.

47. The antibody or antigen binding portion thereof according to claim 32, wherein the antigen binding domain comprises a light chain variable region (VL) comprising three CDRs from SEQ ID NO:500 or the amino acid sequence of SEQ ID NO:500.

48. The antibody or antigen binding portion thereof according to claim 32, wherein the antigen binding domain comprises a light chain variable region (VL) comprising three CDRs from SEQ ID NO:508 or the amino acid sequence of SEQ ID NO:508.

49. The antibody or antigen binding portion thereof according to claim 32, wherein the antigen binding domain comprises a light chain variable region (VL) comprising three CDRs from SEQ ID NO:517 or the amino acid sequence of SEQ ID NO:517.

50. The antibody or antigen binding portion thereof according to claim 32, wherein the antigen binding domain comprises a light chain variable region (VL) comprising three CDRs from SEQ ID NO:523 or the amino acid sequence of SEQ ID NO:523.

51. The antibody or antigen binding portion thereof according to claim 32, wherein the antigen binding domain comprises a light chain variable region (VL) comprising three CDRs from SEQ ID NO:539 or the amino acid sequence of SEQ ID NO:539.

52. The antibody or antigen binding portion thereof according to claim 32, wherein the antigen binding domain comprises a light chain variable region (VL) comprising three CDRs from SEQ ID NO:553 or the amino acid sequence of SEQ ID NO:553.

53. The antibody or antigen binding portion thereof according to claim 32, wherein the antigen binding domain comprises
a heavy chain variable region (VH) comprising three CDRs from SEQ ID NO:403 or the amino acid sequence of SEQ ID NO:403; and
a light chain variable region (VL) comprising three CDRs from SEQ ID NO:523 or the amino acid sequence of SEQ ID NO:523.

54. The antibody or antigen binding portion thereof according to claim 32, wherein the antigen binding domain comprises
a heavy chain variable region (VH) comprising three CDRs from SEQ ID NO:383 or the amino acid sequence of SEQ ID NO:383; and
a light chain variable region (VL) comprising three CDRs from SEQ ID NO:500 or the amino acid sequence of SEQ ID NO:500.

55. The antibody or antigen binding portion thereof according to claim 32, wherein the antigen binding domain comprises a heavy chain variable region (VH) comprising three CDRs from SEQ ID NO:368 or the amino acid sequence of SEQ ID NO:368; and
a light chain variable region (VL) comprising three CDRs from SEQ ID NO:489 or the amino acid sequence of SEQ ID NO:489.

56. The antibody or antigen binding portion thereof according to claim 32, wherein the antigen binding domain comprises
 1a heavy chain variable region (VH) comprising three CDRs from SEQ ID NO:389 or the amino acid sequence of SEQ ID NO:389; and
a light chain variable region (VL) comprising three CDRs from SEQ ID NO:553 or the amino acid sequence of SEQ ID NO:553.

57. The antibody or antigen binding portion thereof according to claim 32, wherein the antigen binding domain comprises
 a heavy chain variable region (VH) comprising three CDRs from SEQ ID NO:372 or the amino acid sequence of SEQ ID NO:372; and
a light chain variable region (VL) comprising three CDRs from SEQ ID NO:517 or the amino acid sequence of SEQ ID NO:517.

58. The antibody or antigen binding portion thereof according to claim 32, wherein the antigen binding domain comprises
 a heavy chain variable region (VH) comprising three CDRs from SEQ ID NO:377 or the amino acid sequence of SEQ ID NO:377; and
a light chain variable region (VL) comprising three CDRs from SEQ ID NO:539 or the amino acid sequence of SEQ ID NO:539.

59. The antibody or antigen binding portion thereof according to claim 32, wherein the antigen binding domain comprises
 a heavy chain variable region (VH) comprising three CDRs from SEQ ID NO:407 or the amino acid sequence of SEQ ID NO:407; and
a light chain variable region (VL) comprising three CDRs from SEQ ID NO:508 or the amino acid sequence of SEQ ID NO:508.

60. The antibody or antigen binding portion thereof according to claim 32, wherein the antigen binding domain comprises
 a heavy chain variable region (VH) comprising three CDRs from SEQ ID NO:455 or the amino acid sequence of SEQ ID NO:455; and
a light chain variable region (VL) comprising three CDRs from SEQ ID NO:47 or the amino acid sequence of SEQ ID NO:47.

61. The antibody or antigen binding portion thereof according to claim 32, wherein the antigen binding domain comprises
 a heavy chain variable region (VH) comprising three CDRs from SEQ ID NO:454 or the amino acid sequence of SEQ ID NO:454; and
a light chain variable region (VL) comprising three CDRs from SEQ ID NO:47 or the amino acid sequence of SEQ ID NO:47.

62. The antibody or antigen binding portion thereof according to claim 32, further comprising a heavy chain immunoglobulin constant domain, wherein the heavy chain immunoglobulin constant domain comprises the amino acid sequence of SEQ ID NO:3 or SEQ ID NO:4.

63. The antibody or antigen binding portion thereof according to claim 32, further comprising a human Ig kappa constant domain, wherein the human Ig kappa constant domain comprises the amino acid sequence of SEQ ID NO:5.

64. The antibody or antigen binding portion thereof according to claim 32, further comprising a human Ig lambda constant domain, wherein the human Ig lambda constant domain comprises the amino acid sequence of SEQ ID NO:6.

* * * * *

UNITED STATES PATENT AND TRADEMARK OFFICE
CERTIFICATE OF CORRECTION

| | | |
|---|---|---|
| PATENT NO. | : 8,835,610 B2 | Page 1 of 1 |
| APPLICATION NO. | : 12/718841 | |
| DATED | : September 16, 2014 | |
| INVENTOR(S) | : Chung-Ming Hsieh et al. | |

It is certified that error appears in the above-identified patent and that said Letters Patent is hereby corrected as shown below:

In the Claims:

At column 301, lines 14-15, delete "the substitution of I at position 5 is selected from the group consisting of F, I, M, V, S, and L;"

and insert --the substitution of I at position 5 is selected from the group consisting of F, M, V, S, and L;--

At column 307, lines 32-33, delete "HQSS#LPHS, residues 89-97 of SEQ ID NO:496 (CDR-L3),"

and insert --HQSSLPHS, residues 89-97 of SEQ ID NO:496 (CDR-L3),--

Signed and Sealed this
Twenty-fourth Day of March, 2015

Michelle K. Lee
*Director of the United States Patent and Trademark Office*